(12) United States Patent
Kaneko et al.

(10) Patent No.: US 8,932,990 B2
(45) Date of Patent: Jan. 13, 2015

(54) DETECTION OF DIGESTIVE ORGAN CANCER, GASTRIC CANCER, COLORECTAL CANCER, PANCREATIC CANCER, AND BILIARY TRACT CANCER BY GENE EXPRESSION PROFILING

(75) Inventors: Shuichi Kaneko, Kanazawa (JP); Masao Honda, Kanazawa (JP); Yoshio Sakai, Kanazawa (JP); Taro Yamashita, Kanazawa (JP)

(73) Assignee: National University Corporation Kanazawa University, Ishikawa (JP)

( * ) Notice: Subject to any disclaimer, the term of this patent is extended or adjusted under 35 U.S.C. 154(b) by 13 days.

(21) Appl. No.: 13/391,858

(22) PCT Filed: Aug. 3, 2010

(86) PCT No.: PCT/JP2010/063122

§ 371 (c)(1),
(2), (4) Date: Feb. 23, 2012

(87) PCT Pub. No.: WO2011/024618

PCT Pub. Date: Mar. 3, 2011

(65) Prior Publication Data

US 2012/0157341 A1 Jun. 21, 2012

(30) Foreign Application Priority Data

Aug. 24, 2009 (JP) .................. 2009-193702

(51) Int. Cl.
C40B 30/04 (2006.01)
*C12Q 1/68* (2006.01)
C40B 40/06 (2006.01)

(52) U.S. Cl.
CPC ........ *C12Q 1/6886* (2013.01); *C12Q 2600/158* (2013.01)
USPC .......................................................... 506/9

(58) Field of Classification Search
USPC ........................................................ 506/9, 16
See application file for complete search history.

(56) References Cited

U.S. PATENT DOCUMENTS

2005/0260572 A1 11/2005 Kato et al.
2006/0269921 A1* 11/2006 Segara et al. .............. 435/6

(Continued)

FOREIGN PATENT DOCUMENTS

JP 2005-304497 A 11/2005
JP 2007-074916 A 3/2007

(Continued)

OTHER PUBLICATIONS

Malati, T. Indian Journal of Clinical Biochemistry, 2007, 22(2), pp. 17-31.*

(Continued)

*Primary Examiner* — Larry Riggs
*Assistant Examiner* — Karla Dines
(74) *Attorney, Agent, or Firm* — Lucas & Mercanti, LLP

(57) ABSTRACT

The present invention provides a method and a reagent for detecting a digestive organ cancer, gastric cancer, colorectal cancer, pancreatic cancer, or biliary tract cancer patient by analyzing genes with expression levels (in peripheral blood) that vary in association with digestive organ cancer, gastric cancer, colorectal cancer, pancreatic cancer, or biliary tract cancer cases, compared with normal healthy subjects. Specifically, the method for detecting a digestive organ cancer, gastric cancer, colorectal cancer, pancreatic cancer, or biliary tract cancer patient based on expression profiles comprises obtaining the expression profile of at least one gene selected from the group consisting of probes corresponding to genes with expression levels (in peripheral blood) that vary in digestive organ cancer, gastric cancer, colorectal cancer, pancreatic cancer, and biliary tract cancer cases, compared with normal healthy subjects. The reagent for detecting digestive organ cancer, gastric cancer, colorectal cancer, pancreatic cancer, or biliary tract cancer contains nucleotides or partial sequences thereof consisting of the nucleotide sequence of at least one gene selected from the group consisting of probes with expression levels that vary in digestive organ cancer, gastric cancer, colorectal cancer, pancreatic cancer, or biliary tract cancer, or nucleotides containing sequences complementary thereto.

6 Claims, 220 Drawing Sheets

(56) References Cited

U.S. PATENT DOCUMENTS

| | | | |
|---|---|---|---|
| 2007/0065844 A1* | 3/2007 | Golub et al. .................... 435/6 |
| 2010/0086537 A1 | 4/2010 | Sooknanan et al. |
| 2012/0036101 A1* | 2/2012 | Rosenberg et al. ............. 706/52 |
| 2012/0040849 A1* | 2/2012 | Simon Valles et al. ........... 506/9 |

FOREIGN PATENT DOCUMENTS

| | | | |
|---|---|---|---|
| JP | 2007-236253 A | 9/2007 |
| NL | WO 2009/002175 A1 * | 12/2008 |
| WO | 2007/081740 A2 | 7/2007 |
| WO | 2007/147265 A1 | 12/2007 |
| WO | WO2008/147205 A1 * | 12/2008 |
| WO | 2009/126271 A1 | 10/2009 |

OTHER PUBLICATIONS

Marshall et al., International Journal of Cancer, 126, Mar. 1, 2010, pp. 1177-1186.*

Masao Honda, et al., "Shokaki Gan to Idenshi Ijo", Biotherapy, 2007, vol. 21, pp. 153 to 159.

Hansel, D.E., et al., "Identification of novel cellular targets in biliary tract cancers using global gene expression technology", Am. J. Pathol., 2003, vol. 163, pp. 217-229.

Karamitopoulou, E., et al., "Clinical significance of cell cycle- and apoptosisrelated markers in biliary tract cancer: a tissue microarray-based approach revealing a distinctive immunophenotype for intrahepatic and extrahepatic cholangiocarcinomas", Am. J. Clin. Pathol., 2008, vol. 130, pp. 780-786.

Hiroshi Yokozaki, "Shokudo Gan, I Gan no Akuseido o Kitei suru Bunshi Joho no Haaku to sore o Oyo shita Seiken Shindanho no Kakuritsu", Ministry of Health, Labour and Welfare Gan Kenkyu Joseikin ni yoru Kenkyu Hokokushu, Heisei 17 Nendo (2005), pp. 607 to 610.

Wataru Yasui, "I Gan no Bunshi Byorigakuteki Shindan", Japanese Journal of Cancer and Chemotherapy, 2005, vol. 32, pp. 427 to 431.

Kawaguchi, K., et al., "Differential gene alteration among hepatoma cell lines demonstrated by cDNA microarray-based comparative genomic hybridization", Biochem. Biophys. Res. Commun., 2005, vol. 329, pp. 370 to 380.

Jun, Lu, et al: "Micro RNA expression profiles classify human cancers", Nature: International Weekly Journal of Science, Nature Publishing Group, United Kingdom, vol. 435. No. 7043, Jun. 9, 2005. pp. 834-838, the whole document.

Extended European Search Report dated Mar. 1, 2013 issued in the corresponding European Application No. 10811669.0.

* cited by examiner

Fig. 1-1

| No | Probe ID No. | Symbols of genes | Sequence | SEQ ID NO: | Descriptions of genes (letters and numbers within [ ] indicates GenBank accession No.) |
|---|---|---|---|---|---|
| 1 | A_23_P100292 | ZNF598 | TGAATCTTTTATGAGAGAAGCTGAATCTGGGATCTGAAATTGCCTGCTGACGTTTTATAA | SEQ ID NO: 1 | Homo sapiens mRNA for FLJ00086 protein, partial cds. [AK024487] |
| 2 | A_23_P100954 | ZBTB4 | GTATTTGAGCTGGGGAATTTGAATATTGTGAGTTTCAGATGTTGGAAATTTGGGATTTTG | SEQ ID NO: 2 | Homo sapiens zinc finger and BTB domain containing 4 (ZBTB4), mRNA [NM_020899] |
| 3 | A_23_P100779 | UBTF | CAGGACGTGCAGCATATAAAGAGTACATCTCAATAAACGTAAGAGCATGACCAAGCTG | SEQ ID NO: 3 | Homo sapiens upstream binding transcription factor, RNA polymerase I (UBTF), transcript variant 1, mRNA [NM_014233] |
| 4 | A_23_P101308 | ENST00000221462 | TAGTTCCTTTTTCCGGTGGGTCTGCGATAGAGTGAGGGCAGAGCCATGAGAATCTGTC | SEQ ID NO: 4 | Homo sapiens hypothetical protein LOC284352, mRNA (cDNA clone IMAGE:4779950), with apparent retained intron. [BC039061] |
| 5 | A_23_P101332 | FLJ12949 | ACAGGTCTGGCACCCACAAGTACTATCTGGTGCAGAGATCGTGTCATCTGTGGCGAGGCA | SEQ ID NO: 5 | Homo sapiens hypothetical protein FLJ12949 (FLJ12949), transcript variant 1, mRNA [NM_023008] |
| 6 | A_23_P101551 | BCAT2 | TCCGTACCAAATGACTCACCTGAAGTGCAATACGAAATAAAAGGCCAGCGGCGGCCTGTG | SEQ ID NO: 6 | Homo sapiens branched chain aminotransferase 2, mitochondrial (BCAT2), mRNA [NM_001190] |
| 7 | A_23_P102404 | CCT7 | GGGGTAGATAGTGGTATGGAGTAGACATGAACAACGAGGACATTGCTGACAACTTTGAAGCTT | SEQ ID NO: 7 | Homo sapiens chaperonin containing TCP1, subunit 7 (eta) (CCT7), transcript variant 1, mRNA [NM_006429] |
| 8 | A_23_P102508 | SLC5A6 | TTTTTCTCGTGGCTTGCCAATCTGTTTTTAAAGGATCAGGGTCGTAGGGAGGAAGGATCA | SEQ ID NO: 8 | Homo sapiens solute carrier family 5 (sodium-dependent vitamin transporter), member 6 (SLC5A6), mRNA [NM_021095] |
| 9 | A_23_P102973 | DGCR14 | TGGGCTCATAGAGCGTCACAGAGCCTGCAGGGCAGCGTGTACACCCAGCAGAGGACTCGA | SEQ ID NO: 9 | Homo sapiens DiGeorge syndrome critical region gene 14 (DGCR14), mRNA [NM_022719] |
| 10 | A_23_P102994 | PIK4CA | AAGATGGAGGCCAGACGCACACCCTTCAAGTGGTTCATGGAGATGTGTCCGAGGCTACGTGGCT | SEQ ID NO: 10 | Homo sapiens phosphatidylinositol 4-kinase, catalytic, alpha polypeptide (PIK4CA), transcript variant 1, mRNA [NM_002650] |
| 11 | A_23_P103104 | MFNG | CCAATTGTGATGATCCATTTCTGCCATTCCCAGCGCTTTCTTGTTAGGGCTACCAC | SEQ ID NO: 11 | Homo sapiens MFNG O-fucosylpeptide 3-beta-N-acetylglucosaminyltransferase (MFNG), mRNA [NM_002405] |
| 12 | A_23_P103942 | DNAJC11 | CTGTAACATTCATCTGCATTTTTAAAAAGGTTTCTCTGACGGCGCCACGGCCGGAGCC | SEQ ID NO: 12 | Homo sapiens DnaJ (Hsp40) homolog, subfamily C, member 11 (DNAJC11), mRNA [NM_018198] |
| 13 | A_23_P103968 | AKR7A3 | ACAGCCTGTGGCCGGTCTCTTTGGGAATAGGTGGGCAGAGAGATGTACAGGAATCGCTACTG | SEQ ID NO: 13 | Homo sapiens aldo-keto reductase family 7, member A3 (aflatoxin aldehyde reductase) (AKR7A3), mRNA [NM_012067] |
| 14 | A_23_P104641 | C11orf2 | ACTGCCACTTTGTGCAGCTCTACCTGTGCGCGTTTTGTGGGCGACGAAGAACTCGTGCACT | SEQ ID NO: 14 | Homo sapiens chromosome 11 open reading frame2 (C11orf2), mRNA [NM_013265] |
| 15 | A_23_P106532 | CHST14 | AAGGCGTTTGAGGTTGTGAGTGTGGCTGGTATATCGTGGCATGGCCATTTTTCTGATGCATTT | SEQ ID NO: 15 | Homo sapiens dermatan 4 sulfotransferase 1 (D4ST1), mRNA [NM_130468] |
| 16 | A_23_P106575 | GOT2 | CTATTGAGAGATTTCATCCAATTCTACTGCTGCTTGATTGACGATGAAGTCCATCCTATCGAG | SEQ ID NO: 16 | Homo sapiens glutamic-oxaloacetic transaminase 2, mitochondrial (aspartate aminotransferase 2) (GOT2), nuclear gene encoding mitochondrial protein, mRNA [NM_002080] |

Fig. 1-2

| No. | Probe ID No. | Symbols of genes | Sequence | SEQ ID NO: | Descriptions of genes (letters and numbers within [ ] indicate GenBank accession No.) |
|---|---|---|---|---|---|
| 17 | A_23_P106887 | FUS | TATTGACTGCTTGATGGTAAAGAATTCTCCGGAAATCCTATCAAGGTCCATTTGCTAC | SEQ ID NO: 17 | Homo sapiens fusion (involved in t(12:16) in malignant liposarcoma) (FUS), mRNA [NM_004960] |
| 18 | A_23_P106973 | SEPT9 | AGGGCTGTGTTCCTCAATGGGCTTTGCTACGTGCGTCCGGAGAAATTTGTCTTTTGTAT | SEQ ID NO: 18 | Homo sapiens septin 9 (SEPT9), mRNA [NM_006640] |
| 19 | A_23_P1072 | ATP1A1 | TGCCCTGGAATGGGTGTTGGTCTTAGGATGTATCCCCTCAAACGTACCTGGTGGTTCTGT | SEQ ID NO: 19 | Homo sapiens ATPase, Na+/K+ transporting, alpha 1 polypeptide (ATP1A1), transcript variant 1, mRNA [NM_000701] |
| 20 | A_23_P108376 | THADA | CTGTGTGGAAGAGCATGACATCAGGTGGAAGAAGACTACGCTGTTGAAAAGCAGAAGTCAA | SEQ ID NO: 20 | Homo sapiens thyroid adenoma associated (THADA), transcript variant 1, mRNA [NM_022065] |
| 21 | A_23_P109001 | KIAA0406 | TGATGGAACGCGTGCATCCACTTGTTGTCAGATAAAAATCTGCAAATCCGGCTGAAGGTGT | SEQ ID NO: 21 | Homo sapiens KIAA0406 (KIAA0406), mRNA [NM_014657] |
| 22 | A_23_P110062 | EIF2B5 | CATTGAGGAGTTCTTCCTAGAGCATGAAAGTCTTGGTATTTCCATGGGCAAGGTACTGAT | SEQ ID NO: 22 | Homo sapiens eukaryotic translation initiation factor 2B, subunit 5 epsilon, 82kDa (EIF2B5), mRNA [NM_003907] |
| 23 | A_23_P111745 | ZMIZ2 | TGGGTGGGCTCTCAGATTCAGCCTCTGTGTAAAGATTCTCTGAGGGGCTGGGCTCCCAAGT | SEQ ID NO: 23 | Homo sapiens zinc finger, MIZ-type containing 2 (ZMIZ2), transcript variant 1, mRNA [NM_031449] |
| 24 | A_23_P112406 | GTF3C5 | AGCTGACCGTAGCACTGGGTGTGCAACATGCTGCTTGGTGGTGCCTCTGGTCCTGAGGGGGTT | SEQ ID NO: 24 | Homo sapiens general transcription factor IIIC, polypeptide 5, 63kDa (GTF3C5), mRNA [NM_012087] |
| 25 | A_23_P113026 | PARN | GAGTGTGGGCTGTGTGGAAATCGCAAAAGAGGTGAGATAGTCGCCTGTTTTCCTGTGATCATGAATT | SEQ ID NO: 25 | Homo sapiens poly(A)-specific ribonuclease (deadenylation nuclease) (PARN), mRNA [NM_002582] |
| 26 | A_23_P113184 | FTO | TTGGGGCATGACCCAGGCCTATGGTTGGCATACTCGCCTCTTTTCTGCGTTTTTTCATTA | SEQ ID NO: 26 | Homo sapiens fatso (FTO), mRNA [NM_001080432] |
| 27 | A_23_P116840 | C12orf44 | CTGGGGCAGATGTCCTTGGAGTTCTACCAGAAGAAGAGTCTCGCTGGCCATTCTCAGAC | SEQ ID NO: 27 | Homo sapiens chromosome 12 open reading frame 44 (C12orf44), mRNA [NM_021834] |
| 28 | A_23_P119095 | PPP1R13L | AGTCACTGCTGACACATCCTCCAAGCAGTCTTGGGTGTCTGGCTGGGAAAGATTGGTCT | SEQ ID NO: 28 | Homo sapiens protein phosphatase 1, regulatory (inhibitor) subunit 13 like (PPP1R13L), mRNA [NM_006663] |
| 29 | A_23_P119907 | ANKZF1 | GACAAATCAACAGGTAATGAGTTCCGAAGGTTCATGGAGAAGAATCCAGATGCCTACGAT | SEQ ID NO: 29 | Homo sapiens ankyrin repeat and zinc finger domain containing 1 (ANKZF1), transcript variant 1, mRNA [NM_018089] |
| 30 | A_23_P120146 | TGFBRAP1 | AAATGGCTTTTGTGAGGCCTGTGTTTGTTAGATACCCAAATGGTGGTCTGTGCACACCA | SEQ ID NO: 30 | Homo sapiens transforming growth factor, beta receptor associated protein 1 (TGFBRAP1), mRNA [NM_004257] |
| 31 | A_23_P120915 | ANKRD54 | ACCTTGTATGGCCAAAGGGGCTTTGGCAGATGTAATGAAGTTAAGGATGTTTCGGCAGGAA | SEQ ID NO: 31 | Homo sapiens ankyrin repeat domain 54 (ANKRD54), mRNA [NM_138797] |
| 32 | A_23_P120821 | ANKRD54 | TTTTCTCCGAGTCATTGAAAGACCAAAACTATTATACCGGGAGGGTGTAATAGTTTTGCT | SEQ ID NO: 32 | Homo sapiens ankyrin repeat domain 54 (ANKRD54), mRNA [NM_138797] |
| 33 | A_23_P120942 | XRCC6 | TTTATGTTTTGAGGCTTTCTGTTGCCATGGTGATGGTGTAGCCCTGCCACTTTGCTGTT | SEQ ID NO: 33 | Homo sapiens X-ray repair complementing defective repair in Chinese hamster cells 6 (Ku autoantigen, 70kDa) (XRCC6), mRNA [NM_001469] |

Fig. 1-3

| No | Probe ID No. | Symbols of genes | Sequence | SEQ ID NO: | Descriptions of genes (letters and numbers within [ ] indicates GenBank accession No.) |
|---|---|---|---|---|---|
| 34 | A_23_P120947 | XRCC6 | GCAAGAATGAAGGCTATCGTTGAGAAGGCTTGGCTTCACATACAGAAGTGACAGCTTTGAGA | SEQ ID NO: 34 | Homo sapiens X-ray repair complementing defective repair in Chinese hamster cells 6 (Ku autoantigen, 70kDa) (XRCC6), mRNA [NM_001469] |
| 35 | A_23_P121499 | WFS1 | CTGACCTTTCTGAGTGACATGGGTGTGCCAGGCTAGAGTAGGAGGTTCCGGTGTGTGGAA | SEQ ID NO: 35 | Homo sapiens Wolfram syndrome 1 (wolframin) (WFS1), mRNA [NM_006005] |
| 36 | A_23_P122116 | DDX41 | GGGGCGCTGAGGAAACACAGGACATCGGCACTACGTTCATCAACAAAGCGTGTGATGAGTGA | SEQ ID NO: 36 | Homo sapiens DEAD (Asp-Glu-Ala-Asp) box polypeptide 41 (DDX41), mRNA [NM_016222] |
| 37 | A_23_P122679 | DAXX | CAGAGGAGCCCTTCACCACTGTCTTAGAGAATGGAGGAGGCATGGTCTCTTCTACTTCCT | SEQ ID NO: 37 | Homo sapiens death-associated protein 6 (DAXX), mRNA [NM_001350] |
| 38 | A_23_P122650 | LOC649233 | CCACGCCCTGGTGGAAAGATGGTGAGGAGCTTCAATCTTGGTGATGCGCTGAGACAGCAGTAA | SEQ ID NO: 38 | PREDICTED: Homo sapiens similar to Keratin, type I cytoskeletal 18 (Cytokeratin-18) (CK-18) (Keratin-18) (K18) (LOC649233), mRNA [XR_018843] |
| 39 | A_23_P122876 | TAF6 | TTGCTTCGTTCATGTGTCACTTTCTTTTAGATATTGTACAAGCAGTTTGTGAGAATAAAAG | SEQ ID NO: 39 | Homo sapiens TAF6 RNA polymerase II, TATA box binding protein (TBP)-associated factor, 80kDa (TAF6), transcript variant 1, mRNA [NM_005641] |
| 40 | A_23_P124044 | DEAF1 | GGAAGGTAAAGAAACTTGCCTGGACAAGTCAATTAACACACACTTTAAGCGAATGGTGCCCTGG | SEQ ID NO: 40 | Homo sapiens deformed epidermal autoregulatory factor 1 (Drosophila) (DEAF1), mRNA [NM_021008] |
| 41 | A_23_P124522 | DCAKD | TAGGCGAAACTTGCCTGGTTTCTACTAGACTGTAAGCCGTGTAGGGACAGGGACAGT | SEQ ID NO: 41 | Homo sapiens dephospho-CoA kinase domain containing (DCAKD), mRNA [NM_024819] |
| 42 | A_23_P126689 | USP21 | AGAAGCCGGAGCTCCTGTATACCAGCTGTATGCCGTTTGCAACCAGTCAGGAGGGTCC | SEQ ID NO: 42 | Homo sapiens ubiquitin specific peptidase 21 (USP21), transcript variant 1, mRNA [NM_012475] |
| 43 | A_23_P126790 | SARS | CAGGACTGCAAGAACTGATGCCCTTTGTGAAGCCTGCGGCCATTGAGCAGGAGCCATCAA | SEQ ID NO: 43 | Homo sapiens seryl-tRNA synthetase (SARS), mRNA [NM_006513] |
| 44 | A_23_P127079 | PPRC1 | ACCGGGAAGACTTGACCCAGCACCTGTAAAGAGCAAATTTGATTCTGTTGAAGTTTGACA | SEQ ID NO: 44 | Homo sapiens peroxisome proliferator-activated receptor gamma, coactivator-related 1 (PPRC1), mRNA [NM_015062] |
| 45 | A_23_P127394 | CRY2 | AGATGGTTGCAGGGCAAAATGCACGTTGGCGATTATAGAGATTTCTGTATTGTGGGAAGGTGTGTTTC | SEQ ID NO: 45 | Homo sapiens cryptochrome 2 (photolyase-like) (CRY2), mRNA [NM_021117] |
| 46 | A_23_P127525 | ETS1 | CCTGCTGAGACCTTCCAAGAGACACCCGTGTTGGTTGGACTCTGAATTTTGAATTGTTATT | SEQ ID NO: 46 | Homo sapiens v-ets erythroblastosis virus E26 oncogene homolog 1 (avian) (ETS1), mRNA [NM_005238] |
| 47 | A_23_P127793 | EML3 | TGCAAGCAGCTGAAGAATCGGTATGAGAGCCGAGAGACCGGGAAATGGGGTACCTACACCGTGT | SEQ ID NO: 47 | Homo sapiens echinoderm microtubule associated protein like 3 (EML3), mRNA [NM_153265] |
| 48 | A_23_P129678 | SETD1A | GCTGACGAGATGCGGTCATCGAATACGTGGGTCAGAACATCCGTCAGATGGTGCGGACATG | SEQ ID NO: 48 | Homo sapiens SET domain containing 1A (SETD1A), mRNA [NM_014712] |
| 49 | A_23_P130149 | ENO3 | CTCGGAGGCGTCTGGCCAAATACAACGAAGTCATGATGAGGATGGAGGAGGCTGTTGGGGACAA | SEQ ID NO: 49 | Homo sapiens enolase 3 (beta, muscle) (ENO3), transcript variant 1, mRNA [NM_001976] |
| 50 | A_23_P13033 | RBM4 | TTACGGGCATGAGAGTGAGGATGTTGTCCGAAGTTCAGCAGGAGATGAGGAGAATTCTCTGTACGA | SEQ ID NO: 50 | Homo sapiens RNA binding motif protein 4 (RBM4), mRNA [NM_002896] |
| 51 | A_23_P130455 | MZF1 | GTGTGGGAAGGCTTCCGGCAGGGGCCCACGCTCACGAGGATGTGCGGCACCGACGACG | SEQ ID NO: 51 | Homo sapiens myeloid zinc finger 1 (MZF1), transcript variant 2, mRNA [NM_198055] |

Fig. 1-4

| No. | Probe ID No. | Symbols of genes | Sequence | SEQ ID NO: | Descriptions of genes (letters and numbers within [ ] indicate GenBank accession No.) |
|---|---|---|---|---|---|
| 52 | A_23_P130753 | DBP | CACGAGAACGTTTGACCCTCGAAGAGCATCGCTTCTCAGAAGAGGAA CTTAAGCGCCAGCCA | SEQ ID NO: 52 | Homo sapiens D site of albumin promoter (albumin D-box) binding protein (DBP), mRNA [NM_001352] |
| 53 | A_23_P131626 | ASCC3L1 | CTTTTGGGTAAAGGAGGAGTTGAGCGTGAATTAGGAATGTGTACAT TGTAGGAATCCTGGT | SEQ ID NO: 53 | Homo sapiens activating signal cointegrator 1 complex subunit 3-like 1 (ASCC3L1), mRNA [NM_014014] |
| 54 | A_23_P13338 | INTS5 | TAAAGCCACCCAAGTTTGTCCAGTCACGAAATCAGCAGGAAGTGA TCTATAACACCCAGA | SEQ ID NO: 54 | Homo sapiens integrator complex subunit 5 (INTS5), mRNA [NM_030628] |
| 55 | A_23_P135104 | MRPS2 | TTCTCAATCTAAATGCCTTTGAGGTGGGCGGGTTCCTTGGCTACG TGGTTCCAGGGGGCT | SEQ ID NO: 55 | Homo sapiens mitochondrial ribosomal protein S2 (MRPS2), nuclear gene encoding mitochondrial protein, mRNA [NM_016034] |
| 56 | A_23_P135634 | MAGED1 | TTGAGTGAGATGTTGGATATTGTGCTATATCGCAGTAGTCTTTCC CCTGCTGTGACCTGAA | SEQ ID NO: 56 | Homo sapiens NRAGE mRNA, complete cds. [AF217963] |
| 57 | A_23_P135914 | SF3B3 | TTAATTGGTTTCTTGTAAATACAGTTTTGTACAATGTTATCTGT GTGGGAGGAAGGAGG | SEQ ID NO: 57 | Homo sapiens splicing factor 3b, subunit 3, 130kDa (SF3B3), mRNA [NM_012426] |
| 58 | A_23_P135977 | CKAP5 | AAGTCCTACATAGTTTAAAATGGCCTCAGGAGGCCTAGTGTATACA AACTGGTTGTATGTA | SEQ ID NO: 58 | Homo sapiens cytoskeleton associated protein 5 (CKAP5), transcript variant 1, mRNA [NM_001008938] |
| 59 | A_23_P137073 | ZMYM3 | GGGTTCTGTGACCCATCCCGCACATAGGTAGAGCTCTGTTGTTGAGG CATGACCTAGGGAAA | SEQ ID NO: 59 | Homo sapiens zinc finger, MYM-type 3 (ZMYM3), transcript variant 1, mRNA [NM_005096] |
| 60 | A_23_P137423 | IGSF8 | TACCATCACTTCCTCCTTCGTCATGAAGAGGCTTGAAAACGGTGATC CCTTACTCCCCAGGT | SEQ ID NO: 60 | Homo sapiens immunoglobulin superfamily, member 8 (IGSF8), mRNA [NM_052866] |
| 61 | A_23_P137715 | POGK | GGGAGGTTAAAGATTTTACACAGACCTAATTTTGGGTTCCTTCCT TGAGCCATAGTTAC | SEQ ID NO: 61 | Homo sapiens pogo transposable element with KRAB domain (POGK), mRNA [NM_017542] |
| 62 | A_23_P138058 | NOC2L | TTCAGTCGGCGAAGTGTTTGAAAATTTGGTTCCTTTCGTTTGAAGT CACATTTCTTTTAA | SEQ ID NO: 62 | Homo sapiens nucleolar complex associated 2 homolog (S. cerevisiae) (NOC2L), mRNA [NM_015658] |
| 63 | A_23_P13885 | ATN1 | CTCGCCCGTTGGTGTGATTATTTCATCTGTTAGATGTTGGCTGTTT TGGGTAGCATGGTGT | SEQ ID NO: 63 | Homo sapiens atrophin 1 (ATN1), transcript variant 1, mRNA [NM_001007026] |
| 64 | A_23_P141180 | TOM1L2 | GCTACTGAAAAGAGGAAATGTGTTGAATGTCGCGTTTGGTGTCGAC TCGTCGTAGAAGTTT | SEQ ID NO: 64 | Homo sapiens target of myb1-like 2 (chicken) (TOM1L2), transcript variant 3, mRNA [NM_001082968] |
| 65 | A_23_P144484 | C17orf63 | ATTCTGTAGTGATGATCTGAAGCAATGTGACTGAAGACCAGTTTTAAG TTATGTGTTGGCAAG | SEQ ID NO: 65 | Homo sapiens chromosome 17 open reading frame 63 (C17orf63), transcript variant 2, mRNA [NM_018182] |
| 66 | A_23_P141779 | CXXC1 | GTGCTACGGCAAGTATGAGAGCCAGAGTGCTTGGGTCCATGTA CCCACACGCATTGA | SEQ ID NO: 66 | Homo sapiens CXXC finger 1 (PHD domain) (CXXC1), mRNA [NM_014593] |
| 67 | A_23_P142018 | PRPF31 | TCAAGGGCAGAAGAGTGGCCTTATGTCCAGCTGAATGACTGGGT GTGTGCAAGGTGGCT | SEQ ID NO: 67 | Homo sapiens PRP31 pre-mRNA processing factor 31 homolog (S. cerevisiae) (PRPF31), mRNA [NM_015629] |
| 68 | A_23_P142272 | PAF1 | AAAATTGCTCGGGAGTACAACTGGAACGTGAAGAACAAAGCTAGCA AGGGCTATGAGGAAA | SEQ ID NO: 68 | Homo sapiens Paf1, RNA polymerase II associated factor, homolog (S. cerevisiae) (PAF1), mRNA [NM_019088] |
| 69 | A_23_P143580 | KLHL22 | ACAACAATGTCCAAGGATTTCGAGCAGAGATCCCGGATCGTGGAGGT ATGAGCCAGGGCACA | SEQ ID NO: 69 | Homo sapiens kelch-like 22 (Drosophila) (KLHL22), mRNA [NM_032775] |

Fig. 1-5

| No. | Probe ID No. | Symbols of genes | Sequence | SEQ ID NO: | Descriptions of genes (letters and numbers within [ ] indicates GenBank accession No.) |
|---|---|---|---|---|---|
| 70 | A_23_P144202 | EEFSEC | GTTGATGTTGTTCAGTCCTGGTCCAAGATAACTTTGACCAGGAGCCTATACTGGAACTCTTT | SEQ ID NO: 70 | Homo sapiens eukaryotic elongation factor, selenocysteine-tRNA-specific (EEFSEC), mRNA [NM_021937] |
| 71 | A_23_P145289 | GNL1 | AACACCCCTGGTGTGCCTGGGACATCTGTGAAGCCTGGGCAGGAGAAACGTTGTTACAAGA | SEQ ID NO: 71 | Homo sapiens guanine nucleotide binding protein-like 1 (GNL1), mRNA [NM_005275] |
| 72 | A_23_P145935 | EPHB6 | GAGGACAACTTCTCCAAGTTTGGCCTGTACGTTCAGTGATGTGGGTCAGCTCAGGCTA | SEQ ID NO: 72 | Homo sapiens EPH receptor B6 (EPHB6), mRNA [NM_004445] |
| 73 | A_23_P146637 | OPRS1 | ATTTGAAGAATGCTTGAAGTCAGGGTGTTGCATTCCAGAAAGACCCCCATTCTCCTTTG | SEQ ID NO: 73 | Homo sapiens opioid receptor, sigma 1 (OPRS1), transcript variant 1, mRNA [NM_005866] |
| 74 | A_23_P147641 | TCEA2 | ATCGAGGAATGCATCTTCCGGGAGCGTTGGAAACACAGAACATGAAAGTATAAGAACCATGTA | SEQ ID NO: 74 | Homo sapiens transcription elongation factor A (SII), 2 (TCEA2), transcript variant 1, mRNA [NM_003195] |
| 75 | A_23_P148473 | IL2RG | CTTTCCTGTTTGGCATTGGAAGCCGGTGGTTATCTCTGTTGGCTCCATGGGATTGATTATCA | SEQ ID NO: 75 | Homo sapiens interleukin 2 receptor, gamma (severe combined immunodeficiency) (IL2RG), mRNA [NM_000206] |
| 76 | A_23_P150255 | RBM14 | GATGGTGAGGGGCACAGTCCCACTTCCCCATCTGCCCAAGTAGGTGGTGTTAGAAAACCT | SEQ ID NO: 76 | Homo sapiens RNA binding motif protein 14 (RBM14), mRNA [NM_006328] |
| 77 | A_23_P150403 | VPS11 | ACGAGATCTCATGATGAATTCGAGCATCAGCTCAAGTGCTCGAATGACAGCTTTCTGT | SEQ ID NO: 77 | Homo sapiens vacuolar protein sorting 11 homolog (S. cerevisiae) (VPS11), mRNA [NM_021729] |
| 78 | A_23_P150852 | FAM62A | GCCTTTGGCTGACCAAAGAAGAAAGACCGTATGTTCCGTTTACTGCAGGGCCTTTATCCT | SEQ ID NO: 78 | Homo sapiens family with sequence similarity 62 (C2 domain containing), member A (FAM62A), mRNA [NM_015292] |
| 79 | A_23_P150931 | LMBR1L | AGAGTTTGGGACCAGGAGCCTCCTGCCTTTTCCATACTTAACTGTGGCCTCAGCATGGGTA | SEQ ID NO: 79 | Homo sapiens limb region 1 homolog (mouse)-like (LMBR1L), mRNA [NM_018113] |
| 80 | A_23_P151426 | FOXO1 | GAAGGTTAGTGAGCAGGTTACAGTTAAAAGTAGTTCAGATTGTGTGACACGAGGAACTGA | SEQ ID NO: 80 | Homo sapiens forkhead box O1A (FOXO1A), mRNA [NM_002015] |
| 81 | A_23_P15247 | C16orf5 | GTGAATGATCAGACCCTGGTAGGTAAGGAAGTTGTCCCTTTGAGTCAGTGTGCAGAAC | SEQ ID NO: 81 | Homo sapiens chromosome 16 open reading frame 5 (C16orf5), mRNA [NM_013399] |
| 82 | A_23_P152818 | MYST2 | CAAAGTAATGTCCACTTTTCGCCTTTCATGCTGCATATAAGTGGTTAATTATACTGCAGA | SEQ ID NO: 82 | Homo sapiens MYST histone acetyltransferase 2 (MYST2), mRNA [NM_007067] |
| 83 | A_23_P152992 | AK125872 | GGCAACAAAGCAAGACGCCTGGTCTCCACCAAAAATAAGTAATTAATTTTTAAAGGAGA | SEQ ID NO: 83 | Homo sapiens cDNA FLJ43694 fis, clone TBAES2001492. [AK125872] |
| 84 | A_23_P153892 | XRCC1 | CGATACGTCACAGCCTTCAATGGGGAGCTCGAGGACTATATGAGTGACCGGGTTCAGTTT | SEQ ID NO: 84 | Homo sapiens X-ray repair complementing defective repair in Chinese hamster cells 1 (XRCC1), mRNA [NM_006297] |
| 85 | A_23_P154962 | KIAA1666 | TTGCTGATAACGTATGGCAGGTATACGGAGGAGAAGCGGCGTTTTTCTGTGGCCAATGTGTGTTT | SEQ ID NO: 85 | Homo sapiens KIAA1666 protein, mRNA (cDNA clone IMAGE:4827837), complete cds. [BC035246] |
| 86 | A_23_P155027 | MORC2 | GGCACCTTGGTTTGACTTACACGGGGACATTTGTGTTTTTGGAGGAAAAGATACGCCTGATTC | SEQ ID NO: 86 | Homo sapiens MORC family CW-type zinc finger 2 (MORC2), mRNA [NM_014941] |
| 87 | A_23_P155257 | FOXP1 | CAACCACAGTCCAGATTTTGACCACAGAGAGATTACGGAAGAATGAACCAGTAAACGAGGA | SEQ ID NO: 87 | Homo sapiens forkhead box P1 (FOXP1), transcript variant 1, mRNA [NM_032682] |

Fig. 1-6

| No. | Probe ID No. | Symbols of genes | Sequence | SEQ ID NO: | Descriptions of genes (letters and numbers within [ ] indicates GenBank accession No.) |
|---|---|---|---|---|---|
| 88 | A_23_P15603 | MRM1 | CGAGCCCAGGGAGGGACCCGTTCCTCGTTGAACCAGTCATTGCGTGTGG CAAATGTGTGTATGA | SEQ ID NO: 88 | Homo sapiens mitochondrial rRNA methyltransferase 1 homolog (S. cerevisiae) (MRM1), mRNA [NM_024864] |
| 89 | A_23_P158897 | BE531123 | TAGGAAGATGAATACCTTACAAGCTGAAAGCTGAAAGCTGGAAGTTCCCG AAAGGGTTTGGGTAT | SEQ ID NO: 89 | BE531123 601278493F1 NIH_MGC_39 Homo sapiens cDNA clone IMAGE:3610487 5', mRNA sequence [BE531123] |
| 90 | A_23_P1594 | VEGFB | TGTCTCAGTTTCTGAACCACTCTGTGTGCAAGTAAGCATCTTTACAGT GGCTCTCTCGCCT | SEQ ID NO: 90 | Homo sapiens vascular endothelial growth factor B (VEGFB), mRNA [NM_003377] |
| 91 | A_23_P161257 | PDCD11 | CAGCACAGACCCAAGCTAGTTGTTGAAGCCAGTTCTTTTTTGTCT GGTCATGAGGGAATT | SEQ ID NO: 91 | RRP5 protein homolog (Programmed cell death protein 11). [Source:Uniprot/SWISSPROT:Acc:O14690] [ENST00000369797] |
| 92 | A_23_P16143 | GTF2F1 | ACCTGACACGGAAGGCGATGACCACTAAGGACCTGCTGAAAAAGT TCCAACCAAGAAGA | SEQ ID NO: 92 | Homo sapiens general transcription factor IIF, polypeptide 1, 74kDa (GTF2F1), mRNA [NM_002096] |
| 93 | A_23_P161562 | ZNF289 | TGTGATGAATTCCTTGCAAGGATGGCTAGGGTTCCTACTGATCCGA GCTCTGTGACTCAGG | SEQ ID NO: 93 | Homo sapiens zinc finger protein 289, ID1 regulated (ZNF289), mRNA [NM_032389] |
| 94 | A_23_P161918 | CCDC86 | AAATACABACAATAGACGAAAGTCCCTGCCGTCGAGGAGGCTTTCA TTCTGATGGAGAGAA | SEQ ID NO: 94 | Homo sapiens coiled-coil domain containing 86 (CCDC86), mRNA [NM_024098] |
| 95 | A_23_P162120 | NUMA1 | AGAAGAAAGGAGGTCCAGGTTCTGTACTAAACAGAAAATTGATGATCGTGACTC AGTCGATGGCCTTCA | SEQ ID NO: 95 | Homo sapiens nuclear mitotic apparatus protein 1 (NUMA1), mRNA [NM_006185] |
| 96 | A_23_P162374 | DDX54 | CTATCAGAAGTGGAAACAGAAACAGGAAGGTCAGAGAAAGAAGAGGGC | SEQ ID NO: 96 | Homo sapiens DEAD (Asp-Glu-Ala-Asp) box polypeptide 54 (DDX54), mRNA [NM_024072] |
| 97 | A_23_P162525 | UTP20 | GTAGGCAATTGGATCGTTGGGATAGACAAGGTAAAGGCGTATCTCCAA ATGATCATAGGTCCT | SEQ ID NO: 97 | Homo sapiens UTP20, small subunit (SSU) processome component, homolog (yeast) (UTP20), mRNA [NM_014503] |
| 98 | A_23_P163258 | PARP6 | GACGGCAAGATACGAAGAGGAAATCATGCGTGTGATGGAAGTCAG GTTTACACAAACTGA | SEQ ID NO: 98 | Homo sapiens poly (ADP-ribose) polymerase family, member 6 (PARP6), mRNA [NM_020214] |
| 99 | A_23_P164718 | SNRPA | TCACCAACCTGCCAGGAGACCAACGAGGTCATGCTGTCCATGC TTTTCAATCAGTTCC | SEQ ID NO: 99 | Homo sapiens small nuclear ribonucleoprotein polypeptide A (SNRPA), mRNA [NM_004596] |
| 100 | A_23_P166280 | THC2614148 | CTCAGGGGAGTTCTCAGCTTGGACCCTTATCTCCCAGAATCCTG GAAGCTGGTCCTCT | SEQ ID NO: 100 | Q59G86_HUMAN (Q59G86) Androgen-regulated short-chain dehydrogenase/reductase 1 variant (Fragment), partial (7%) [THC2614148] |
| 101 | A_23_P166491 | RUTBC3 | ATTCCCGGTCTGGTCGTCTGTCTCTATAAGACGTCAGGTTGGATGAAGATG CCAAAGTCCTGACCG | SEQ ID NO: 101 | Homo sapiens RUN and TBC1 domain containing 3 (RUTBC3), mRNA [NM_015705] |
| 102 | A_23_P166609 | DHX30 | CGTACGATATAGGACAAATCAGGCAACATCCTGCTGCACAAGTC GACGATTAACAGGGA | SEQ ID NO: 102 | Homo sapiens DEAH (Asp-Glu-Ala-His) box polypeptide 30 (DHX30), transcript variant 2, mRNA [NM_014966] |
| 103 | A_23_P168826 | DCP1A | CATTCTTCACGTGATAATGGAGGTTTCAGTGTGAAGCATCACCAGCA GATCCTTGTTTTGAC | SEQ ID NO: 103 | Homo sapiens DCP1 decapping enzyme homolog A (S. cerevisiae) (DCP1A), mRNA [NM_018403] |
| 104 | A_23_P167093 | IDUA | ACATACGAGCATCCAGTTGTCTTCAGGACGGTAAGGCGGTACACCCGG GTCAGGAGGAAGCCA | SEQ ID NO: 104 | Homo sapiens iduronidase, alpha-L- (IDUA), mRNA [NM_000203] |
| 105 | A_23_P168541 | C7orf26 | TGGAGGGAAGAGTCCAGCCTGTGCCGAGAGCCTGCTGCGTGCATT TTTAAAGATGCCGA | SEQ ID NO: 105 | Homo sapiens chromosome 7 open reading frame 26 (C7orf26), mRNA [NM_024067] |
| 106 | A_23_P171336 | USP11 | ACTTTGATGACAACAGCGTCTCGCCTGTCAATGAGAATCAGAATCG AGTCCAAGGCAGGCT | SEQ ID NO: 106 | Homo sapiens ubiquitin specific peptidase 11 (USP11), mRNA [NM_004651] |

Fig. 1-7

| No. | Probe ID No. | Symbols of genes | Sequence | SEQ ID NO: | Descriptions of genes (letters and numbers within [ ] indicates GenBank accession No.) |
|---|---|---|---|---|---|
| 107 | A_23_P18205 | RAD54L2 | GAGGTTGGGTTCAGCTCCAATGATGATGAGGATAAAGACGATGATGTGATAGAGGTCACT | SEQ ID NO: 107 | Homo sapiens RAD54-like 2 (S. cerevisiae) (RAD54L2), mRNA [NM_015106] |
| 108 | A_23_P20489 | TMEM63A | CTCCTGGGGATTCTGGGGAATGGAACTGAACTTAAGAGCTTCTGCCTGAGAAGCCTCCTCC | SEQ ID NO: 108 | Homo sapiens transmembrane protein 63A (TMEM63A), mRNA [NM_014698] |
| 109 | A_23_P202156 | NFKB2 | GGCCACACGCGCTCTTGAGCTCACTTGAGCGACGCAAGGTGAAGACCTTGCTGGTAAATGCT | SEQ ID NO: 109 | Homo sapiens nuclear factor of kappa light polypeptide gene enhancer in B-cells 2 (p49/p100) (NFKB2), transcript variant 2, mRNA [NM_002502] |
| 110 | A_23_P202708 | MADD | GTGTCCTTGAGACATTTGTGTTGTGGTTCCTTGTCCTGTCCCTGGGGTTATAACTGTCC | SEQ ID NO: 110 | Homo sapiens MAP-kinase activating death domain (MADD), transcript variant 4, mRNA [NM_003682] |
| 111 | A_23_P203406 | GANAB | CCTTTGAGGGGCAGTTAAGATGGAGAAATCAGTTGTGGTTTCAGTGAATCATCGGTCACCT | SEQ ID NO: 111 | Homo sapiens glucosidase, alpha; neutral AB (GANAB), transcript variant 2, mRNA [NM_198334] |
| 112 | A_23_P203488 | SMPD1 | GTGTACCAAATAGATGGAAAACTAGTCCGGGAGGTCTCACGTGGTCCTGACCATGAGACC | SEQ ID NO: 112 | Homo sapiens sphingomyelin phosphodiesterase 1, acid lysosomal (acid sphingomyelinase) (SMPD1), transcript variant 1, mRNA [NM_000543] |
| 113 | A_23_P203737 | INTS4 | ACCATTCGGTTCAGCAAGCCTGTAAAACTAGTCCGGGAGGTTTATATAATGGGCAAACCTGACCACGGCGCTAA | SEQ ID NO: 113 | Homo sapiens integrator complex subunit 4 (INTS4), mRNA [NM_033547] |
| 114 | A_23_P203819 | GOLGA3 | TCTCACAGGAATCCGGAGGGAAAATGTGTTAGAGGGGTCTGGAAAATTCAGTGCTTTTGAGTT | SEQ ID NO: 114 | Homo sapiens golgi autoantigen, golgin subfamily a, 3 (GOLGA3), mRNA [NM_005895] |
| 115 | A_23_P20427 | RHOBTB2 | AGGAGGTATGAATCCCAGTCCCCAGGAACCTAGGTCTGTTAAACTCTGGGAGTCGGATTC | SEQ ID NO: 115 | Homo sapiens Rho-related BTB domain containing 2 (RHOBTB2), mRNA [NM_015178] |
| 116 | A_23_P204364 | NCL1 | GGCAAGACTGAGAATTGTCCACTGTGTCAGTTCTGTCGACAAAGACCGAAGCTTCCTCCAGCTT | SEQ ID NO: 116 | Homo sapiens nucleolar protein 1, 120kDa (NOL1), transcript variant 1, mRNA [NM_006170] |
| 117 | A_23_P205841 | MYO9A | TGAAGGCAAAAGCCTTTGGGGTTTATTTTGGGATAGTTAGGACCTAGGGTAGAATATAATT | SEQ ID NO: 117 | Homo sapiens myosin IXA (MYO9A), mRNA [NM_006901] |
| 118 | A_23_P20722 | SNAPC4 | ATGCTCTTCCCCAAGTGCACACTGAACACTTGGAGGAATAAAGTTCTGTTTTAATTG | SEQ ID NO: 118 | Homo sapiens small nuclear RNA activating complex, polypeptide 4, 190kDa (SNAPC4), mRNA [NM_003086] |
| 119 | A_23_P207319 | MAP3K14 | CAGGAGCTCACGTAGCCATTAAATCAGCTGTGAATCGTCAGGAGGGTGTCTGCTAGCCTGAAC | SEQ ID NO: 119 | Homo sapiens mitogen-activated protein kinase kinase kinase 14 (MAP3K14), mRNA [NM_003954] |
| 120 | A_23_P207736 | AK023077 | TTCGTTAATTCTTGGGGACTGGGACCAGGTGGTGAAGCACGAAGATGACTTCTGAGCGTTTATCACTGTT | SEQ ID NO: 120 | Homo sapiens cDNA FLJ13015 fis, clone NT2RP3000622. [AK023077] |
| 121 | A_23_P20793 | A_23_P20793 | TGCCCTTCCATAAGGTCGGGGTTTGTAGGGGTCTTGTGGTTGCTTCTGGTCTCTCCAAGGTT | SEQ ID NO: 121 | |
| 122 | A_23_P208358 | RPL28 | CACCATCGAACAAGAATAAGTGCTCGGCGCCACGGCTCAAGCAGCATCAAGACATCATGATCCGCCAAGAA | SEQ ID NO: 122 | Homo sapiens ribosomal protein L28 (RPL28), mRNA [NM_000991] |
| 123 | A_23_P208551 | LPHN1 | TCGGGTATCTGGGGAGCAGATTTGGGTCTGGATCCGGTGGGGAGTGGGTCCTGGGCTT | SEQ ID NO: 123 | Homo sapiens latrophilin 1 (LPHN1), transcript variant 1, mRNA [NM_001008701] |
| 124 | A_23_P208582 | A_23_P208582 | GTATTCATGTCGCCTGGGAGTTCCTGCGTCATCATAGTACCCAGTGAGCCCAGAAGATCCTAC | SEQ ID NO: 124 | |
| 125 | A_23_P208961 | MUM1 | CATTGTGGGTTCCTGAGAGTAGGACACATTGGGGATGGCATGGTTTTGTGGGAATCACGGCGCCCT | SEQ ID NO: 125 | Homo sapiens melanoma associated antigen (mutated) 1 (MUM1), mRNA [NM_032853] |
| 126 | A_23_P210319 | DTNB | CAGAGGGACATTCCTCTCCATCTTTCCACGGCACACGTGGACCAGGCTTGACGGCTGCCA | SEQ ID NO: 126 | Homo sapiens dystrobrevin, beta (DTNB), transcript variant 4, mRNA [NM_183360] |

Fig. 1-8

| No. | Probe ID No. | Symbols of genes | Sequence | SEQ ID NO: | Descriptions of genes (letters and numbers within [ ] indicates GenBank accession No.) |
|---|---|---|---|---|---|
| 127 | A_23_P210343 | THIL | ATGGTTCACCTGCTGGTGAAGGTCAAGGTTATGTACTGCTGTTGTCAGTTACATCCGAAAGTGT | SEQ ID NO: 127 | Homo sapiens THI-like (Drosophila) (THIL), transcript variant 1, mRNA [NM_198976] |
| 128 | A_23_P211878 | FLNB | GCCCCAAGCCAACTTCATGGGTCACTTCATTTTCGTGGAAAATAATGATCTGTACAGACAGGAGA | SEQ ID NO: 128 | Homo sapiens filamin B, beta (actin binding protein 278) (FLNB), mRNA [NM_001457] |
| 129 | A_23_P214687 | TRIM26 | ATTATGTCTAGAATTGGTCGTTGTGAGGGGGAGTTTAAGAATCGAGAACTGTCTCTTG | SEQ ID NO: 129 | Homo sapiens tripartite motif-containing 26 (TRIM26), mRNA [NM_003449] |
| 130 | A_23_P214638 | EHMT2 | GGTCTTCATGCTGCACCAAGAACCTGCGATTTGCACGCATCGGCTTCTTCAGTTCCCCGAGA | SEQ ID NO: 130 | Homo sapiens euchromatic histone-lysine N-methyltransferase 2 (EHMT2), transcript variant NG36/09a, mRNA [NM_006709] |
| 131 | A_23_P21495 | FCGBP | TCAGTCATCCACCAGGAACGAAGGATTTCCTGAAGAAGACCTGGTCCCTCTGGAGGTTGCG | SEQ ID NO: 131 | Homo sapiens Fc fragment of IgG binding protein (FCGBP), mRNA [NM_003890] |
| 132 | A_23_P215175 | ABCF2 | GAGGGTGGGTATGATGTCGTCAGCCATGACTCAGACTCATTCAGCAGGTTGCACAGGAA | SEQ ID NO: 132 | Homo sapiens ATP-binding cassette, sub-family F (GCN20), member 2 (ABCF2), nuclear gene encoding mitochondrial protein, transcript variant 2, mRNA [NM_005692] |
| 133 | A_23_P215449 | BAZ1B | CAGGTCCTAGAACATGAGAATCAAGCCTCTTAATTTAAACTGCGGAATGTGGCCTCTGC | SEQ ID NO: 133 | Homo sapiens bromodomain adjacent to zinc finger domain, 1B (BAZ1B), mRNA [NM_032408] |
| 134 | A_23_P21640 | CHD3 | GTCCAATGGGCGACGGAGGAGAAAGAGAGAGAACCCCCGGTCATGTTCAATATCGCCGA | SEQ ID NO: 134 | Homo sapiens chromodomain helicase DNA binding protein 3 (CHD3), transcript variant 1, mRNA [NM_001005273] |
| 135 | A_23_P217028 | USP20 | GGGAAGGGGCTGTGGGACCAGGACCCCCCACAGTACTGCGTCTTTG TTTCTATGAGTCTT | SEQ ID NO: 135 | Homo sapiens ubiquitin specific peptidase 20 (USP20), transcript variant 1, mRNA [NM_001008563] |
| 136 | A_23_P218086 | TPCN1 | TCCTAGAAAACCCATTGTGTCTGTCTGGATCTGTAGCACGATTACTACGAAGAGCCTCTGGTTT | SEQ ID NO: 136 | Homo sapiens mRNA for KIAA1169 protein, partial cds. [AB032995] |
| 137 | A_23_P218215 | AA601902 | AACCCTTACTATCCAACAGATTCTGTGTTGCAAATCTATCTACTCGCTAAAATATATCTG | SEQ ID NO: 137 | AA601902_np02b01.s1 NCI_CGAP_Pr2 Homo sapiens cDNA clone IMAGE:1115113 similar to contains Alu repetitive element; mRNA sequence [AA601902] |
| 138 | A_23_P23854 | ZGPAT | GTCCCATCTGGACACTTACTTGCCCACCTGCGAGTGTGTGGGACATTTCCTTGGCAAGGA | SEQ ID NO: 138 | Homo sapiens zinc finger, CCCH-type with G patch domain (ZGPAT), transcript variant 1, mRNA [NM_032527] |
| 139 | A_23_P218751 | GNB1L | GGAGTCCCGCTGTCTCTCAATGAGGTTGGTATTTCCTTTTGTGGAGTGCCTCATCACAGGA | SEQ ID NO: 139 | Homo sapiens guanine nucleotide binding protein (G protein), beta polypeptide 1-like (GNB1L), mRNA [NM_053004] |
| 140 | A_23_P23411 | PRCC | GCAAGAGGAAGCCAGGGAGGGAAGAAGAAATCAACTTGTGGAGATCAAAGGTGATGACCAGC | SEQ ID NO: 140 | Homo sapiens papillary renal cell carcinoma (translocation-associated) (PRCC), transcript variant 1, mRNA [NM_005973] |
| 141 | A_23_P23894 | RIPK5 | AGGGCCAAGCTATCCGTTTAGCAAAAAGTGTCTCAGATGTGTAAAAGCCTAGGGAATGTG | SEQ ID NO: 141 | Homo sapiens receptor interacting protein kinase 5 (RIPK5), transcript variant 1, mRNA [NM_015375] |
| 142 | A_23_P24068 | BMS1 | TCATGAAGAAAGATCGTTGCACTCGTGCGATGCTGAGTACGGTGCATAGTCAGAAGAT | SEQ ID NO: 142 | Homo sapiens BMS1 homolog, ribosome assembly protein (yeast) (BMS1), mRNA [NM_014753] |
| 143 | A_23_P251259 | GTF2H4 | TCTGGGCAAGGATTAGTCTGTGGAAGGTATGAGTGATTCTCTGTTGAACTTCCTGCAACA | SEQ ID NO: 143 | Homo sapiens general transcription factor IIH, polypeptide 4, 52kDa (GTF2H4), mRNA [NM_001517] |

Fig. 1-9

| No. | Probe ID No. | Symbols of genes | Sequence | SEQ ID NO: | Descriptions of genes [letters and numbers within [ ] indicates GenBank accession No.] |
|---|---|---|---|---|---|
| 144 | A_23_P251860 | ABCF1 | CCCACTCTGATTGCATCGATTCTCTGAAAGACTGTTGTTCTGCTTCTCTGATATAA | SEQ ID NO: 144 | Homo sapiens ATP-binding cassette, sub-family F (GCN20), member 1 (ABCF1), transcript variant 2, mRNA [NM_001090] |
| 145 | A_23_P252642 | BBS5 | GAAAAGATTGAGGAATCGGATGGTTGCCGTGTCTGTGTGTAGAAAGAAGTAGACATGGGAGA | SEQ ID NO: 145 | Homo sapiens Bardet-Biedl syndrome 5 (BBS5), mRNA [NM_152384] |
| 146 | A_23_P25348 | ACAD10 | CAGGAGGAGGACAGTGCTTGCTATGTCATAAACGGTCACAAATGGTGGATGACAGGCATCGT | SEQ ID NO: 146 | Homo sapiens acyl-Coenzyme A dehydrogenase family, member 10 (ACAD10), mRNA [NM_025247] |
| 147 | A_23_P255669 | DUS1L | AAAGTGTGACCAGTGTGTGGAAACCCAAAGGCAACAGATGTGTGTTCAGGGTGTGCGGCGG | SEQ ID NO: 147 | Homo sapiens dihydrouridine synthase 1-like (S. cerevisiae) (DUS1L), mRNA [NM_022156] |
| 148 | A_23_P256021 | LAS1L | AGACAACCTGGGAGCAGGCCTGGATCAGCAGCCAATCAACTCAACTTGTCAACGAGGGGAA | SEQ ID NO: 148 | Homo sapiens LAS1-like (S. cerevisiae) (LAS1L), mRNA [NM_031206] |
| 149 | A_23_P257155 | ATXN7 | TTGGTGAAGAGCAGGTGATTCTAGTGTCTTCTCTTGGGCCATTCATCACCAGTCCAATGAAC | SEQ ID NO: 149 | Homo sapiens ataxin 7 (ATXN7), mRNA [NM_000333] |
| 150 | A_23_P258124 | ZNF346 | AAGCTGGGGATCTGCTTTATGTGTGAGAGAACTGTTCTGGGTGTTATGTAAAGGAGTGCA | SEQ ID NO: 150 | Homo sapiens zinc finger protein 346 (ZNF346), mRNA [NM_012279] |
| 151 | A_23_P258190 | AKR1B1 | GTGATCCCAAGTCGTGTGACACCAGAACAGCATTGCTGAGAAGTTAAGGTCTTTGACTTT | SEQ ID NO: 151 | Homo sapiens aldo-keto reductase family 1, member B1 (aldose reductase) (AKR1B1), mRNA [NM_001628] |
| 152 | A_23_P26375 | ACD | GCAAAGAAGGCATCGTGATGATTTCTGCCTTCCAGTATGAGTATGAGCGACCCTGCACGTCC | SEQ ID NO: 152 | Homo sapiens adrenocortical dysplasia homolog (mouse) (ACD), transcript variant 2, mRNA [NM_022814] |
| 153 | A_23_P26810 | TP53 | CTGTGAGGGATGATTTGGGAGATGTAAGAAATGTTCTTGCAGTTAAGGGTTAGTTTAGAAT | SEQ ID NO: 153 | Homo sapiens tumor protein p53 (Li-Fraumeni syndrome) (TP53), mRNA [NM_000546] |
| 154 | A_23_P27894 | SAFB2 | CAGGGTTCCAAGTTGGGAGGATGTTTTAAAAGCAAAGTAAATCGTGCCACCATGTT | SEQ ID NO: 154 | Homo sapiens scaffold attachment factor B2 (SAFB2), mRNA [NM_014649] |
| 155 | A_23_P28857 | SIRPG | TCCGATCCATGGCCTTGAGACTGACGGTAAACCACAGACAGCGCTCTCCAGGTTCTGAAGAGT | SEQ ID NO: 155 | Homo sapiens signal-regulatory protein gamma (SIRPG), transcript variant 2, mRNA [NM_080816] |
| 156 | A_23_P300150 | NFATC1 | AGCCTTTCTCAGGGGACGTGTCATTGAAAAGGAAAGGTTTGATGTCTGTGTCAGGTGTCTT | SEQ ID NO: 156 | Homo sapiens nuclear factor of activated T-cells, cytoplasmic, calcineurin-dependent 1 (NFATC1), transcript variant 3, mRNA [NM_172387] |
| 157 | A_23_P300714 | SORBS3 | ACGCAGGACGCTTCTTAGGGATGTAGGGCTGGCAAGAGGCTGTGGCCCCAAGGCCTCGTCTT | SEQ ID NO: 157 | Homo sapiens sorbin and SH3 domain containing 3 (SORBS3), transcript variant 1, mRNA [NM_005775] |
| 158 | A_23_P300826 | C6orf136 | TACAAGGGTGACAAAGACGAGGATTACCGGACCCTATGATGGCTACTCCACTTCTACGCTG | SEQ ID NO: 158 | Homo sapiens chromosome 6 open reading frame 136 (C6orf136), mRNA [NM_145029] |
| 159 | A_23_P309803 | ZNF777 | TGTAGGGCCCATCTAGTTGGGGATAGAAGCTTTATAATTAGGTTTTGGATACTGTGTTCT | SEQ ID NO: 159 | Homo sapiens zinc finger protein 777 (ZNF777), mRNA [NM_015694] |
| 160 | A_23_P309850 | RPUSD2 | GCTTCTAAAGAGACCTTGCTCATACTTGCTACGTCCTCCAGTGGGAATTTGGGAGCTTT | SEQ ID NO: 160 | Homo sapiens RNA pseudouridylate synthase domain containing 2 (RPUSD2), mRNA [NM_152260] |
| 161 | A_23_P310331 | RANBP3 | CCGCCATGTGTTTTGGAACATTTATGTAAGATTGTCATATGAAATGTATTTGGGAACTAC | SEQ ID NO: 161 | Homo sapiens RAN binding protein 3 (RANBP3), transcript variant RANBP3-a, mRNA [NM_003624] |
| 162 | A_23_P311740 | PARC | CTGCCCTGTCATAGGAGGAGGGGAATTCCCAGGCTGCTGTGAGTGCTTCCTGTTTCCTGAATA | SEQ ID NO: 162 | Homo sapiens p53-associated parkin-like cytoplasmic protein (PARC), mRNA [NM_015089] |

Fig. 1-10

| No. | Probe ID No. | Symbols of genes | Sequence | SEQ ID NO: | Descriptions of genes [letters and numbers within [ ] indicate GenBank accession No.] |
|---|---|---|---|---|---|
| 163 | A_23_P312179 | ALMS1 | GAGATTGTGAAGCAGTGCCAAAAAAGACACTCGAGATGTTGGGATAAGTTTCGCAACTCCA | SEQ ID NO: 163 | Homo sapiens Alstrom syndrome 1 (ALMS1), mRNA [NM_015120] |
| 164 | A_23_P3128 | YLPM1 | AAGAGAAGAAGATGCAGATAGGAAAAGGGCCATAGGTTTGTGGTCGGACAGAGTGATT | SEQ ID NO: 164 | Homo sapiens YLP motif containing 1, mRNA (cDNA clone IMAGE:3835908), complete cds. [BC023570] |
| 165 | A_23_P31477 | NUDCD3 | AAGTGATGCAGTGGTGTGAGATGCGTACACCTGTTATTTGGGAGACTTTGAGAGTCAT | SEQ ID NO: 165 | Homo sapiens NudC domain containing 3 (NUDCD3), mRNA [NM_015332] |
| 166 | A_23_P31489 | URG4 | GAGGAAGTGACGTCACAGACCAGCTCAGAGATGTTACCAAGAATATCACAGCCCACCAGGG | SEQ ID NO: 166 | Homo sapiens up-regulated gene 4 (URG4), transcript variant 1, mRNA [NM_017920] |
| 167 | A_23_P315252 | AK097322 | CATGGGTGGGTGAATAGTACTTGCGGCAGTAGTGCTTAAAAGTAGGCGGCTATGGTATAAT | SEQ ID NO: 167 | Homo sapiens cDNA FLJ40003 fis, clone STOMA2003716. [AK097322] |
| 168 | A_23_P315378 | ATG16L1 | GTGTTGTTTCAGTTTATAGTCTTTGTCCAAAAGTCAGTTTCAAAATAATTTGCAATGGGAC | SEQ ID NO: 168 | Homo sapiens cDNA FLJ10035 fis, clone HEMBA1000919. [AK000897] |
| 169 | A_23_P315843 | NCOA5 | GCCCCGCATGGGATGTTACCAGAGGGCATTACTGAAGGTAAATCTTTCAACTCTCCCCAGTC | SEQ ID NO: 169 | Homo sapiens nuclear receptor coactivator 5 (NCOA5), mRNA [NM_020967] |
| 170 | A_23_P316472 | DNHD1 | TAAGCTGCAGAGCGAGGAACATCGTGATGCATCGTGCCTTTAGCCACCAAAGCTCAGCCCCAA | SEQ ID NO: 170 | Homo sapiens dynein heavy chain domain 1 (DNHD1), mRNA [NM_144666] |
| 171 | A_23_P319270 | AZI1 | GATGCCGCACAGGCTAAGGACGTGTGGGTGCATTTTAACAGTAAGGAGGGCGTTGTTTCA | SEQ ID NO: 171 | Homo sapiens 5-azacytidine induced 1 (AZI1), transcript variant 1, mRNA [NM_014984] |
| 172 | A_23_P320304 | AFAR3 | AGGGTGCCCAAGGCTTTTCGTCAACTCGTTTTGCTCTCGCGCGCTTTGTCTAATTTAGAA | SEQ ID NO: 172 | Homo sapiens aflatoxin B1 aldehyde reductase 3 (AFAR3), mRNA [NM_201252] |
| 173 | A_23_P320837 | DKFZP434A0131 | GCCTCTGAGTCCCATCATCATCTGTTGGGAAAGTCGTTGAAGGTGAACGTCACGGGTGAAACGGGGGCAGAGT | SEQ ID NO: 173 | Homo sapiens mRNA; cDNA DKFZp434A0131 (from clone DKFZp434A0131). [AL137492] |
| 174 | A_23_P32125 | PMPCA | CCCGTTCCGGTGCGTGTTAGTTTGGACACGAAGATTTAGTGTCTAAAAGGTGTCTGGTTGTAT | SEQ ID NO: 174 | Homo sapiens peptidase (mitochondrial processing) alpha (PMPCA), nuclear gene encoding mitochondrial protein, mRNA [NM_015160] |
| 175 | A_23_P321361 | DHX30 | ACCGGTTACACACGGTTACGGAGGCGGATGGCTGAGCTCTATTTCATGGCAGTCAAGTCCAAT | SEQ ID NO: 175 | Homo sapiens DEAH (Asp-Glu-Ala-His) box polypeptide 30 (DHX30), transcript variant 3, mRNA [NM_138614] |
| 176 | A_23_P325093 | GGTL3 | TGGGCGCGAGCTTAGGGATGTGCTTGGCAAACCCTTCTCAAGGGTCTCACAACCCCAACAT | SEQ ID NO: 176 | Homo sapiens gamma-glutamyltransferase-like 3 (GGTL3), mRNA [NM_178026] |
| 177 | A_23_P326142 | NAG8 | CTGTTGGGATTAGGAGTGGAATGAGGAATAGTTTAGGACCACAAGAGATTTGGCGCTGCTT | SEQ ID NO: 177 | Homo sapiens nesopharyngeal carcinoma associated gene protein-8 (NAG8), mRNA [NM_014411] |
| 178 | A_23_P328133 | GOT2 | TCAACTCGATCGGATCGGATCGGAGAATCGGATTATTTAAGAATGAAGAACATAATTTTCGTCGTGATGCCG | SEQ ID NO: 178 | Human mitochondrial aspartate aminotransferase mRNA, complete cds. [M22632] |
| 179 | A_23_P329212 | ETS1 | GTCAACCCAGCCTATCCAGAATCCGGCTATACCTCGGATTACTTCGATTAGCTATGGTATT | SEQ ID NO: 179 | Homo sapiens v-ets erythroblastosis virus E26 oncogene homolog 1 (avian) (ETS1), mRNA [NM_005238] |
| 180 | A_23_P332042 | RECQL5 | CTTTCTGCTTGCAAAGCCTCTTGCAAAGCCTATAGACCCTTCTCAGAGCGGGTCGTCATGGGCTGGGTTTTCTG | SEQ ID NO: 180 | Homo sapiens RecQ protein-like 5 (RECQL5), transcript variant 1, mRNA [NM_004259] |
| 181 | A_23_P336015 | NOC2L | GGAATTTAAAGACCTCTTTGACCTGAACAGGTCTGAAGAGGACGAACACTGAGGGATTCTC | SEQ ID NO: 181 | Homo sapiens nucleolar complex associated 2 homolog (S. cerevisiae) (NOC2L), mRNA [NM_015658] |

Fig. 1-11

| No. | Probe ID No. | Symbols of genes | Sequence | SEQ ID NO: | Descriptions of genes (letters and numbers within [ ] indicates GenBank accession No.) |
|---|---|---|---|---|---|
| 182 | A_23_P336218 | MGC27345 | TGAGTGACTGCTTTGTTGAATCAGATAGTAACAAAACATTTATTTGTAGTCTGGTTGTGTC | SEQ ID NO: 182 | Homo sapiens hypothetical protein MGC27345, mRNA (cDNA clone MGC:27345 IMAGE:4670552), complete cds. [BC024231] |
| 183 | A_23_P336513 | GEMIN5 | AGACCTTGGCAGAAGATGATCGGACAACACCAAAAGAGTCAACTCTGTAAATCCACAGGAA | SEQ ID NO: 183 | Homo sapiens gem (nuclear organelle) associated protein 5 (GEMIN5), mRNA [NM_015465] |
| 184 | A_23_P339095 | SPTBN1 | AGTGGGATAGTTGAAAAGGAGAAGAAGTTTCCCAAAAGGGTTTGCCAGCTGAACAGGGAT | SEQ ID NO: 184 | Homo sapiens spectrin, beta, non-erythrocytic 1 (SPTBN1), transcript variant 2, mRNA [NM_178313] |
| 185 | A_23_P42131 | CYBASC3 | GCTGACCGACTCTGAGGTGTTCGTGTTTCGTATTGCTGCTGTGTGTCTGCATGTATTGTGAC | SEQ ID NO: 185 | Homo sapiens cytochrome b, ascorbate dependent 3 (CYBASC3), mRNA [NM_153611] |
| 186 | A_23_P4496 | TMEM39B | CCTGATCCTCTTCAGCAACTACTACTAGCCTCTTCAAGCTGGTCCGGGACCGGCTTGGTATT | SEQ ID NO: 186 | Homo sapiens transmembrane protein 39B (TMEM39B), mRNA [NM_018056] |
| 187 | A_23_P349310 | TNRC6A | CGTGGGGTGTCTACTATGCCTTGATGTTGGCTACCTTATTGTGGTATGGTGGAGTTTTAA | SEQ ID NO: 187 | Homo sapiens trinucleotide repeat containing 6A (TNRC6A), mRNA [NM_014494] |
| 188 | A_23_P3502 | NHN1 | AGTTGACAGTGTTGAATAAGGCGGCTGATAAAGGAAGGAAGAAGCGCTATGAACCATCAG | SEQ ID NO: 188 | Homo sapiens conserved nuclear protein NHN1 (NHN1), mRNA [NM_144604] |
| 189 | A_23_P356565 | KIAA0409 | TGAGGACAAAGTGTGATAAAACCTGTGGCTCAGACTTGCTCTACTGAAGGCTTCTTGGTT | SEQ ID NO: 189 | Homo sapiens KIAA0409 (KIAA0409), mRNA [NM_015324] |
| 190 | A_23_P359174 | BC069659 | CCAGGCGGTGCATACTAGGGCTGAATAAAGAAAATTTTGTAATAGGAACAGTGGTTTGGGATTTT | SEQ ID NO: 190 | Homo sapiens cDNA clone IMAGE:7262526, with apparent retained intron. [BC069659] |
| 191 | A_23_P36076 | SSRP1 | AATGCAGGATGCCAAATCTCATCTTAGTTTGCCGACCTTAAGGATGTAGCTGCTGCTTGT | SEQ ID NO: 191 | Homo sapiens structure specific recognition protein 1 (SSRP1), mRNA [NM_003146] |
| 192 | A_23_P36140 | B3GAT3 | AGAGAGTCTTCTGAGCCACCTTGTGGATCCCAAGGACCTGGAGCCACGGGCTGCCAACT | SEQ ID NO: 192 | Homo sapiens beta-1,3-glucuronyltransferase 3 (glucuronosyltransferase I) (B3GAT3), mRNA [NM_012200] |
| 193 | A_23_P36157 | WDR74 | TAGAGACACCTATGCAGAGTACCCAGTAACAGCCATGACCCTGACTCGCGGGAGGCAACT | SEQ ID NO: 193 | Homo sapiens WD repeat domain 74 (WDR74), mRNA [NM_018093] |
| 194 | A_23_P364637 | DDX51 | CCTCGTTCCAGAGCAGTGCGTGATCACTGGATCGTGTATGTGAGGAAAGGAATCCCCCAGT | SEQ ID NO: 194 | Homo sapiens DEAD (Asp-Glu-Ala-Asp) box polypeptide 51 (DDX51), mRNA [NM_175066] |
| 195 | A_23_P367676 | SIN3A | CGTGGAACTGTTTTGTATCTGGCTCTTTACTAGTCTACGTTAGTGCCATGCCACGCAGCTT | SEQ ID NO: 195 | Homo sapiens SIN3 homolog A, transcription regulator (yeast) (SIN3A), mRNA [NM_015477] |
| 196 | A_23_P368996 | LRRC56 | CAAACCAACATTTCCAGCTCTCAGGTGTACAGAAATGCGGTTTACTTTGTAGGCACAGTT | SEQ ID NO: 196 | Homo sapiens leucine rich repeat containing 56 (LRRC56), mRNA [NM_198075] |
| 197 | A_23_P371765 | C21orf56 | GAACATCCCCGAGAAGATCGGACAGAGACCTCCAGCAAGTCTGTGGACGGCTCCGTGGACGA | SEQ ID NO: 197 | Homo sapiens chromosome 21 open reading frame 56 (C21orf56), mRNA [NM_032261] |
| 198 | A_23_P37205 | NDRG2 | CGTTTGGCTGCAGTAAGTTTGGTAGCTCAGTGTGCATCTCAGAGTGGGACTGGGAGGGAG | SEQ ID NO: 198 | Homo sapiens NDRG family member 2 (NDRG2), transcript variant 1, mRNA [NM_201535] |
| 199 | A_23_P372255 | ITPKB | TCAGTTGTATTTAGCTTTGAGTTTCTGTGGATCGTCAGCCCATGTGTATATAACCAG | SEQ ID NO: 199 | Homo sapiens inositol 1,4,5-trisphosphate 3-kinase B (ITPKB), mRNA [NM_002221] |
| 200 | A_23_P38219 | PRPF8 | CCAGAACAGAAGGACAAGGGCAACGACGCCAAGGGCTAGCTGCCTTCACAGTATGAGAGGGT | SEQ ID NO: 200 | Homo sapiens PRP8 pre-mRNA processing factor 8 homolog (S. cerevisiae) (PRPF8), mRNA [NM_006445] |

Fig. 1-12

| No. | Probe ID No. | Symbols of genes | Sequence | SEQ ID NO: | Descriptions of genes (letters and numbers within [ ] indicates GenBank accession No.) |
|---|---|---|---|---|---|
| 201 | A_23_P383060 | SLC5A6 | GAAATAGGGATGGAAGTGCATCCTCTGGGAAAAGATAATAGCTTCTGATTCAACATAGC | SEQ ID NO: 201 | Homo sapiens solute carrier family 5 (sodium-dependent vitamin transporter), member 6 (SLC5A6), mRNA [NM_021095] |
| 202 | A_23_P384698 | LOC442075 | CACCTCAGTTGACAAGGAGATGAGAACTATCAGTTCATAGACAGCATCGATAGGGAAG | SEQ ID NO: 202 | Homo sapiens cDNA FLJ35033 fis, clone OCBBF2016590, weakly similar to CELL SURFACE ANTIGEN 114/A10 PRECURSOR. [AK092352] |
| 203 | A_23_P3949 | TRAP1 | ACTCATCAGGAAACTCGGGGACGGTTTTACAGGAGAGGGCTGATCAAATGTTCATTGACCA | SEQ ID NO: 203 | Homo sapiens TNF receptor-associated protein 1 (TRAP1), mRNA [NM_016292] |
| 204 | A_23_P38876 | LIPE | GGGGGACGGGCACACACAGCGGTCACGGAAGCGGCTGGACCTGACCA CGGCACCGGCTGCCTT | SEQ ID NO: 204 | Homo sapiens lipase, hormone-sensitive (LIPE), mRNA [NM_005357] |
| 205 | A_23_P388780 | DMAP1 | GATACCAGTATTTGATGGTGGGCACGAACGACGCGGGAAGGAACAGGTTGAGCGTCTCTA | SEQ ID NO: 205 | Homo sapiens DNA methyltransferase 1 associated protein 1 (DMAP1), transcript variant 1, mRNA [NM_019100] |
| 206 | A_23_P388914 | CCDC101 | CAACAAGTATGAGGTAGATGACATCGATGAAGAAGGCAAAGAGAG ACACACCCTGAGCCG | SEQ ID NO: 206 | Homo sapiens coiled-coil domain containing 101 (CCDC101), mRNA [NM_138414] |
| 207 | A_23_P389907 | ATXN2 | TTTCAGAGTGCCGGCAGGTCGGCCAGGTCTGTTGCCGAAACTGGAAGTTATTATTTT | SEQ ID NO: 207 | Homo sapiens ataxin 2 (ATXN2), mRNA [NM_002973] |
| 208 | A_23_P39034 | SMARCA4 | CTGGCATCAGTAGCATCGTGTAACAGCATTAACTGTCTTAAAGAGAGAGAAGAGAATTCC | SEQ ID NO: 208 | Homo sapiens SWI/SNF related, matrix associated, actin dependent regulator of chromatin, subfamily a, member 4 (SMARCA4), mRNA [NM_003072] |
| 209 | A_23_P39040 | SMARCA4 | AAGGAGCGCATTCGGCAAGCACAGAAGTACCGCAGGCTCAACGACCTAGAGAAGGACGTCATG | SEQ ID NO: 209 | Homo sapiens SWI/SNF related, matrix associated, actin dependent regulator of chromatin, subfamily a, member 4 (SMARCA4), mRNA [NM_003072] |
| 210 | A_23_P391275 | DSCR1L2 | TAAATTATGATTTACTCTGTGCTGTTTCCAAATTGGGACCAGGAGAGAAATATGAACTTC | SEQ ID NO: 210 | Homo sapiens Down syndrome critical region gene 1-like 2 (DSCR1L2), mRNA [NM_013441] |
| 211 | A_23_P3921 | FLJ11710 | CCTGATTCATGATTGAAGTACGATTAAATAATGCTATACATCCATGCATTGGATGTTTA | SEQ ID NO: 211 | Homo sapiens cDNA FLJ11710 fis, clone HEMBA1005149 [AK021772] |
| 212 | A_23_P292501 | TNRC6C | GGTTGTGACTGGTTTTGGGGGAGCCTGGGGTTTGGGCTCCAGCTGTTTACAGACGCTTT | SEQ ID NO: 212 | Homo sapiens cDNA FLJ31859 fis, clone NT2RP7001231 [AK056421] |
| 213 | A_23_P393401 | LOC339047 | CAATGACTTTTCTTTACCCCGCTAGGTGTCGGCAGTAGTCAGTGGAAGGGTGATATTATGA | SEQ ID NO: 213 | Homo sapiens hypothetical protein LOC339047 (cDNA clone IMAGE:4184431), complete cds. [BC068178] |
| 214 | A_23_P394917 | SRCAP | TGGTGGCTGTAATTCAGGATGACGTGGACTTAGCAGAATAGCGGGGCCAGGCGGGTTGGAAT | SEQ ID NO: 214 | Homo sapiens Snf2-related CBP activator protein (SRCAP), mRNA [NM_006662] |
| 215 | A_23_P39844 | MMT | GGCTTGGTGAGGGCAATCAAAATAATGTTTGTGATGCTACTAGTGTTGATTTTGGCGTCG | SEQ ID NO: 215 | Homo sapiens inner membrane protein, mitochondrial (mitofilin) (IMMT), mRNA [NM_006839] |
| 216 | A_23_P40049 | CAD | CCTGACACTGATGTGCTCTACAGATGACTCGAATCCAGAAGGAACGATTTTGGCTCTACCCAG | SEQ ID NO: 216 | Homo sapiens carbamoyl-phosphate synthetase 2, aspartate transcarbamylase, and dihydroorotase (CAD), mRNA [NM_004341] |
| 217 | A_23_P401084 | ZNF575 | CTTTGGGAGATCTCAAACCATGGACATTGGAGCGTGTGTTTGGTTTGACAGCCGCTGGCTCTGCTT | SEQ ID NO: 217 | Homo sapiens zinc finger protein 575 (ZNF575), mRNA [NM_174945] |

Fig. 1-13

| No | Probe ID No. | Symbols of genes | Sequence | SEQ ID NO: | Descriptions of genes (letters and numbers within [ ] indicates GenBank accession No.) |
|---|---|---|---|---|---|
| 218 | A_23_P40194 | DDX27 | CATGTCTGTCAATCTCCGTCTTGTCGATTAGGTTTCATATGACTATATTAAATGGAAGT | SEQ ID NO: 218 | Homo sapiens DEAD (Asp-Glu-Ala-Asp) box polypeptide 27 (DDX27), mRNA [NM_017895] |
| 219 | A_23_P406105 | GCN1L1 | TCTGGGAGGGGTATAGGTTTGAAAGGTGTTTGAAAGAGGAATGTTTAATAAAGGCTT | SEQ ID NO: 219 | Homo sapiens GCN1 general control of amino-acid synthesis 1-like 1 (yeast) (GCN1L1), mRNA [NM_006836] |
| 220 | A_23_P407601 | C8orf6 | GTCTCCTAGGTTAGTGTAGGAGAGATTCTATTCTCAGATAAGACTTCGGTGTCGGCTGAA | SEQ ID NO: 220 | Homo sapiens mRNA for hypothetical protein (C8orf6 gene), [AJ307469] |
| 221 | A_23_P407684 | ZNF598 | TGTCTGCACACACGGACTTCTGCAACGCGCAGAAGGCCTCTGAGCACCAAGTCCAAGAAGA | SEQ ID NO: 221 | Homo sapiens zinc finger protein 598 (ZNF598), mRNA [NM_178167] |
| 222 | A_23_P40989 | USP13 | TGAGATGGAGAATAATGGCAATGCAAACATTATTTGTGAGGCAAGCCCGAAGAGACCTAG | SEQ ID NO: 222 | Homo sapiens ubiquitin specific peptidase 13 (isopeptidase T-3) (USP13), mRNA [NM_003940] |
| 223 | A_23_P41021 | NISCH | TAATTGACTGTCCTCGGCAGAGAATGTGACATGTGTGTGTTGTGTTAATTCTTTCTG | SEQ ID NO: 223 | Homo sapiens nischarin (NISCH), mRNA [NM_007184] |
| 224 | A_23_P410653 | MLLT6 | AAACACAGAGACTGTTGTCTACCAGATGATGCAGGAGATCGAAGGAGAAACGGGAAGGTGCAGC | SEQ ID NO: 224 | Homo sapiens myeloid/lymphoid or mixed-lineage leukemia (trithorax homolog, Drosophila); translocated to, 6 (MLLT6), mRNA [NM_005937] |
| 225 | A_23_P411246 | TMC8 | GTCCTGACGGTGTGGTCTGCAGACCAGGCAATGCAGGGCCATCCACAGGCTCCGG | SEQ ID NO: 225 | Homo sapiens transmembrane channel-like 8 (TMC8), mRNA [NM_152468] |
| 226 | A_23_P41755 | PURA | CAACTCCATCACCGATGCCGTTACAAGGTGTGGGCCAAGTTCGGACACACGTCTCGCAAGTA | SEQ ID NO: 226 | Homo sapiens purine-rich element binding protein A (PURA), mRNA [NM_005859] |
| 227 | A_23_P422305 | SFXN4 | GATTTAACCGTCAAGGCCAATTGATAGTGAGAGGTTAAGGGCACAGAGTTGATCA | SEQ ID NO: 227 | Homo sapiens cDNA FLJ37976 fis, clone CTONG2010148, [AK095295] |
| 228 | A_23_P423457 | SERINC5 | TTTTGGTTCTTTAAACTTCTGCTGTTGGGGGCCATGTGCTCAGGAGCTTTCTTCATTCCA | SEQ ID NO: 228 | Homo sapiens serine incorporator 5 (SERINC5), mRNA [NM_178276] |
| 229 | A_23_P425932 | VTI1A | TACCTCAAAAATAGAACAAGACACTCCATGCGTGCGGATGACTGTCAAGGTCACTGA | SEQ ID NO: 229 | Vesicle transport through interaction with t-SNAREs homolog 1A (Vesicle transport v-SNARE protein Vti1-like 2) (Vti1-rp2). [Source:Uniprot/SWISSPROT;Acc:Q96AJ9] [ENST00000369309] |
| 230 | A_23_P431418 | U2AF2 | TGAAGACGATGGGCAGAGAGTGAGAGCGCCAGACACACAGAGCCGGCAGCAACTGGAA | SEQ ID NO: 230 | Homo sapiens U2 small nuclear RNA auxiliary factor 2 (U2AF2), transcript variant 1, mRNA [NM_007279] |
| 231 | A_23_P45108 | QRICH1 | GAAAGGGCTTGGACTGTGAAAAGAAATGTGGCCCTTTCCATCTTCAAGAGAGATGGAAT | SEQ ID NO: 231 | Homo sapiens glutamine-rich 1 (QRICH1), transcript variant 1, mRNA [NM_017730] |
| 232 | A_23_P48964 | VPS33B | CCTCACAGCCGTGGAGAGATAAAGTGAGGCAAGCTGGTGACGGACAAGGCTGCAGGAAAGAT | SEQ ID NO: 232 | Homo sapiens vacuolar protein sorting 33 homolog B (yeast) (VPS33B), mRNA [NM_018668] |
| 233 | A_23_P4922 | LOC374920 | GAGAGTGTCCAGCAGGGGAGGGGGAATTGTTTGGACTATTGTTCTCAGGATTGGAATAAA | SEQ ID NO: 233 | Homo sapiens hypothetical protein LOC374920 (LOC374920), mRNA [NM_199341] |
| 234 | A_23_P49327 | ZNF174 | AATCACAAAACTGTGTGACTTACAAGGAAAGGACGAGGCCTTGAGGAATGATGATGCA | SEQ ID NO: 234 | Homo sapiens zinc finger protein 174 (ZNF174), transcript variant 1, mRNA [NM_003450] |
| 235 | A_23_P4944 | CALM3 | CTCAGTGCCCAGGTCGATCAAGTGGCTTCCTGGGACCTGCCCAGCTTTGAGAATCTCT | SEQ ID NO: 235 | Homo sapiens calmodulin 3 (phosphorylase kinase, delta) (CALM3), mRNA [NM_005184] |

Fig. 1-14

| No. | Probe ID No. | Symbols of genes | Sequence | SEQ ID NO: | Descriptions of genes (letters and numbers within [ ] indicate GenBank accession No.) |
|---|---|---|---|---|---|
| 236 | A_23_P49900 | PELP1 | TGAGTCTCGCCCAAAGGTCAGCCAGACCCGAACCCGAACCCGG GCTGGTTTTGGAAGT | SEQ ID NO: 236 | Homo sapiens proline, glutamic acid and leucine rich protein 1 (PELP1), mRNA [NM_014389] |
| 237 | A_23_P50020 | COG1 | GCATGAAGACGACTCGAAAGGCTAAATCAACCAGAAACATCGAAA CAAAAGCTCAAGCTTG | SEQ ID NO: 237 | Homo sapiens component of oligomeric golgi complex 1 (COG1), mRNA [NM_018714] |
| 238 | A_23_P501795 | SURF5 | CCATCATTCGGAGTCATCATCGTCGTGTTTGCTGCGTTCCTCGGCCAG CCAGGTGGAAGAAAG | SEQ ID NO: 238 | Homo sapiens surfeit 5 (SURF5), transcript variant b, mRNA [NM_133640] |
| 239 | A_23_P501887 | DHPS | GCTGATGCCCATTCTGGACCAAGATGGTGATGGAGCAGAACACAGA GGGTGTAAAGTGGAC | SEQ ID NO: 239 | Homo sapiens deoxyhypusine synthase (DHPS), transcript variant 3, mRNA [NM_013407] |
| 240 | A_23_P502196 | IDH3B | CATGTGAAGTGACTTCCTGGGTATATGACTCGGCACGAACAATGTA GACCTGGTGATCATT | SEQ ID NO: 240 | Homo sapiens isocitrate dehydrogenase 3 (NAD+) beta (IDH3B), nuclear gene encoding mitochondrial protein, transcript variant 2, mRNA [NM_174855] |
| 241 | A_23_P50472 | ALDH16A1 | CTGTGGCTGCCTATGGCGGACTGATGCGTGAGGCGCACCCTACTGC ATTTTGGACACCTCA | SEQ ID NO: 241 | Homo sapiens aldehyde dehydrogenase 16 family, member A1 (ALDH16A1), mRNA [NM_153329] |
| 242 | A_23_P51639 | KIAA0467 | GGTTCCAATCCGAGGTCTGCCTTTGAAGGACTGTGGCGACCCTG AAGTCCGTTGCTCT | SEQ ID NO: 242 | Homo sapiens KIAA0467 (KIAA0467), mRNA [NM_015284] |
| 243 | A_23_P53015 | TUT1 | CATATAGAAGCAGCAACCAAGAGAACGCGGTCAGGAAGGAGGTGGA ACTGGGGAGTCGTCT | SEQ ID NO: 243 | Homo sapiens terminal uridylyl transferase 1, U6 snRNA-specific (TUT1), mRNA [NM_022830] |
| 244 | A_23_P33641 | CHD4 | TGCTGAGTGACATGAAAGGCTGATGTGACTCGAGTCAAGGAGAGGTCCAGGTACCA TTGGCGGAATTCCCC | SEQ ID NO: 244 | Homo sapiens chromodomain helicase DNA binding protein 4 (CHD4), mRNA [NM_001273] |
| 245 | A_23_P56091 | FTSJ3 | GAGTCAGAGGTCATTTCAAGGTGGTGGACTCCAAGGATGAAGAAGG ACCAAAGAGCACAGC | SEQ ID NO: 245 | Homo sapiens FtsJ homolog 3 (E. coli) (FTSJ3), mRNA [NM_017647] |
| 246 | A_23_P553 | TARS2 | GTCCCAAATGCGGAAGAAATTTTCTGAGCTTCTGTACATAGATGA GGCAAAAACGTGGCA | SEQ ID NO: 246 | Homo sapiens threonyl-tRNA synthetase 2, mitochondrial (putative) (TARS2), mRNA [NM_025150] |
| 247 | A_23_P56948 | PRR12 | TGTCTCTTGCTCTTTCTTGGGCTTCTGTACAAGTCAAGCTGTATA CACTGTGTACACACA | SEQ ID NO: 247 | Homo sapiens mRNA for KIAA1205 protein, partial cds. [AB033031] |
| 248 | A_23_P56127 | C19orf61 | GTCAACTTATTCGTGCGTACCGTTCATGACGAGATCGAAGCAGAGAGT GAAACCCGACCAAGA | SEQ ID NO: 248 | Homo sapiens hypothetical protein FLJ12886 (FLJ12886), mRNA [NM_019108] |
| 249 | A_23_P57236 | GGTL3 | CGAAGGACGAACAACTCATCATCGGTCGTTAAGGACCGCTCGGAGC CCAGATGCAGCTGGA | SEQ ID NO: 249 | Homo sapiens gamma-glutamyltransferase-like 3 (GGTL3), mRNA [NM_178026] |
| 250 | A_23_P67819 | TATDN2 | TAGTTTTCTGTGTAGGATTTAGATTATCATTTATGTGCTGTTGGA CAGTGAAACCCTCACC | SEQ ID NO: 250 | Homo sapiens TatD DNase domain containing 2 (TATDN2), mRNA [NM_014760] |
| 251 | A_23_P586 | DMAP1 | CTCTGCTGAGCCGGCAGTGACTGACGAACCGGACTTGGTCCTGACCGC CAAGGACGACATCAT | SEQ ID NO: 251 | Homo sapiens DNA methyltransferase 1 associated protein 1 (DMAP1), transcript variant 1, mRNA [NM_019100] |
| 252 | A_23_P60180 | ABL1 | AGGGCCCTAGGTTTACGGCTCATCACCTAAAGCTTGTACTTTATTTTT CTGATAGAAATGGTT | SEQ ID NO: 252 | Homo sapiens v-abl Abelson murine leukemia viral oncogene homolog 1 (ABL1), transcript variant a, mRNA [NM_005157] |
| 253 | A_23_P60657 | KIAA0460 | TTATAACAAAGGGGCTCCTCTTCCAAAGTAAGAAATCACATACGGT TACGGTTTTACTATTC | SEQ ID NO: 253 | Homo sapiens KIAA0460 (KIAA0460), mRNA [NM_015203] |
| 254 | A_23_P61268 | C8orf30A | TGAAGGAGCTTAGGTTGTCTTCTTGGCAATTCAGAATGGGTCACT CCACACCCTAAACT | SEQ ID NO: 254 | Homo sapiens chromosome 8 open reading frame 30A (C8orf30A), mRNA [NM_016458] |

Fig. 1-15

| No | Probe ID No. | Symbols of genes | Sequence | SEQ ID NO: | Descriptions of genes (letters and numbers within [ ] indicates GenBank accession No.) |
|---|---|---|---|---|---|
| 255 | A_23_P6223 | SFRS15 | AAATGACCGGGAACGGTATGGGAACCGTAATGATGATAGAGATAATAGTAACGGTGACAG | SEQ ID NO: 255 | Homo sapiens splicing factor, arginine/serine-rich 15 (SFRS15), mRNA [NM_020706] |
| 256 | A_23_P62868 | EXOSC10 | TGGGAAACAAAAGCATGTGCTTCGAACTGGAAAGTCAGACAGAGAGCTTCAGGTACAACT | SEQ ID NO: 256 | Homo sapiens exosome component 10 (EXOSC10), transcript variant 1, mRNA [NM_001001998] |
| 257 | A_23_P63128 | OBSCN | CCTCGCTTCAGCGCGGCGGGATTCTTCGCGCTGCATTTGTTGCATTGTTTGCATTAATATGAAT | SEQ ID NO: 257 | Homo sapiens cDNA FLJ14124 fis, clone MAMMA1002498. [AK024186] |
| 258 | A_23_P63281 | MGC10334 | GAACCAGGGTGAAGGTCACAGGTCCCAGGGTGTGGAGGGCTCCATCCTTTCTCGTTTCTGCC | SEQ ID NO: 258 | Homo sapiens hypothetical protein MGC10334 (MGC10334), mRNA [NM_001029985] |
| 259 | A_23_P64770 | DDX23 | AGTGGAATCTTAGTGTCATCATCGGAGAGAGCTGTTTCCTGTTGGATGGTAAAGGAAGTTGA | SEQ ID NO: 259 | Homo sapiens DEAD (Asp-Glu-Ala-Asp) box polypeptide 23 (DDX23), mRNA [NM_004818] |
| 260 | A_23_P65797 | KLHL25 | GACGTGCCATGGTGCTTTCCGCAAAAGTTGTGTTGCTTTTATCAGTTTTCTAACTTAATA | SEQ ID NO: 260 | Homo sapiens kelch-like 25 (Drosophila) (KLHL25), mRNA [NM_022480] |
| 261 | A_23_P65890 | CIB2 | TGTGGCCTCGAAGCTCCCCAGGAAGAAAGCACGTGGGCAGCCTGTGGGGTTTACACACAAATAT | SEQ ID NO: 261 | Homo sapiens calcium and integrin binding family member 2 (CIB2), mRNA [NM_006383] |
| 262 | A_23_P66867 | GEMIN4 | AAAGAAAATAGTTTCTTGGGTATTTGTAACGTACAAAACTACATAAAAATTCTCTGTTT | SEQ ID NO: 262 | Homo sapiens gem (nuclear organelle) associated protein 4 (GEMIN4), mRNA [NM_015721] |
| 263 | A_23_P6602 | RRP9 | CCGATGGTGGAGAATCAAAGAGAGGCTGGAATTCTGTCTGCATGATCCCACTCCGCAGGGT | SEQ ID NO: 263 | Homo sapiens RRP9, small subunit (SSU) processome component, homolog (yeast) (RRP9), mRNA [NM_004704] |
| 264 | A_23_P68087 | ATIC | GCAGAAGAAAGGAATGGGTTGAGAAACTGACTGAAGTTCTATCAGCTCTGATGCGTTC | SEQ ID NO: 264 | Homo sapiens 5-aminoimidazole-4-carboxamide ribonucleotide formyltransferase/IMP cyclohydrolase (ATIC), mRNA [NM_004044] |
| 265 | A_23_P71146 | POLD2 | CTTCCGTGAGAGACGCAGGGAAGTTCTGGTGGAGGACTATTGCTTTGCTGACGTTGCTCC | SEQ ID NO: 265 | Homo sapiens polymerase (DNA directed), delta 2, regulatory subunit 50kDa (POLD2), mRNA [NM_006230] |
| 266 | A_23_P71889 | ODF2 | AAGATCCTTAAAGATGAGATGAACAAAAGAGATTGAAGGCGGCACGAAGCAGTTCCAGTGT | SEQ ID NO: 266 | Homo sapiens outer dense fiber of sperm tails 2 (ODF2), transcript variant 2, mRNA [NM_153437] |
| 267 | A_23_P73160 | ENST00000354261 | TGGTTGTTCATTAGACTCCTGGATATTCTTAAAATACAGATTCACATTCAGTAGAG | SEQ ID NO: 267 | Leucine-rich repeat and calponin homology domain-containing protein 3 precursor. [Source:Uniprot/SWISSPROT;Acc:Q961I8] [ENST00000354261] |
| 268 | A_23_P73604 | CXorf34 | ACTGCATTACAGAGGTGATTCAAGCCATTCGAAAGTTCAGGGCCATCCACAGGCTAGTTTT | SEQ ID NO: 268 | Homo sapiens chromosome X open reading frame 34 (CXorf34), mRNA [NM_024917] |
| 269 | A_23_P74269 | SRM | TCGTATTACCAGCTCATGATGAAGACAGCCCTCAAGGAAGATGGTGTCCTCTGTGCCAGGGC | SEQ ID NO: 269 | Homo sapiens spermidine synthase (SRM), mRNA [NM_003132] |
| 270 | A_23_P74653 | NUDC | GGCAGGCAGCAGATCATTGATGGGGAGCCTCTACAATGAAGTGAAGGTGGAAGGAGGGTCGT | SEQ ID NO: 270 | Homo sapiens nuclear distribution gene C homolog (A. nidulans) (NUDC), mRNA [NM_006600] |
| 271 | A_23_P75609 | CEP164 | CTGGGACAGCTTGGTGTATATTGGGCATTGTTTCCATCGTCTTTTGTACCTGTGCA | SEQ ID NO: 271 | Homo sapiens centrosomal protein 164kDa (CEP164), mRNA [NM_014956] |
| 272 | A_23_P77437 | PRMT7 | AGAAAATCTTCAAGGCTAAGCACACTTGGAAGATAAAATTAACATCATAGAAAACGGCCG | SEQ ID NO: 272 | Homo sapiens protein arginine methyltransferase 7 (PRMT7), mRNA [NM_019023] |

Fig. 1-16

| No. | Probe ID No. | Symbols of genes | Sequence | SEQ ID NO: | Descriptions of genes (letters and numbers within [ ] indicates GenBank accession no.) |
|---|---|---|---|---|---|
| 273 | A_23_P77440 | NFATC3 | GTGTCAGTTACAACGTTATTAGACATATGGTCGTTCACATTCAGGGGTCTGGCTACAACAGCTTC | SEQ ID NO: 273 | Homo sapiens nuclear factor of activated T-cells, cytoplasmic, calcineurin-dependent 3 (NFATC3), transcript variant 4, mRNA [NM_173164] |
| 274 | A_23_P77502 | PKD1 | CCTGCACCGTCTCACTGTGTCTGTGTCGTGTCAGTAATTTATATGGTGTTAAAATGTGTATA | SEQ ID NO: 274 | Homo sapiens polycystic kidney disease 1 (autosomal dominant) (PKD1), transcript variant 1, mRNA [NM_001009944] |
| 275 | A_23_P78170 | MYBBP1A | CTGGCACGGGAAAAAGGCAAGGCTGTGTTTGGTCATCAGGAGTGCCAGCCTGCTCAGAGT | SEQ ID NO: 275 | Homo sapiens MYB binding protein (P160) 1a (MYBBP1A), mRNA [NM_014520] |
| 276 | A_23_P78191 | C17orf68 | TGCCTACTTGTTCTGTGATTGAACCAAGGAGTCCAGATTCACAAACTGGTACTCCAGTAT | SEQ ID NO: 276 | Homo sapiens chromosome 17 open reading frame 68 (C17orf68), mRNA [NM_025099] |
| 277 | A_23_P78685 | FARSA | CCTGGAGCGCCCAACGATGATCAAATATGGCATGACAATATCCGGGAGCTGGTGGGCCA | SEQ ID NO: 277 | Homo sapiens phenylalanyl-tRNA synthetase, alpha subunit (FARSA), mRNA [NM_004461] |
| 278 | A_23_P79927 | NOL5A | GCCACATACTGCCGTCTTGCCCAGTTTATTGGAAAACCGAAGGGAACTGAATGAGGACAAG | SEQ ID NO: 278 | Homo sapiens nucleolar protein 5A (56kDa with KKE/D repeat) (NOL5A), mRNA [NM_006392] |
| 279 | A_23_P80129 | RRP1 | CTCCGCCTGTGGCTGTGATGACCTTGGGGCCAAGAAGGTCAAAGTCCGAAGAGTGAAAGTCT | SEQ ID NO: 279 | Homo sapiens DNA segment on chromosome 21 (unique) 2056 expressed sequence (D21S2056E), mRNA [NM_003683] |
| 280 | A_23_P80136 | RRP1 | TGAATGAACTGGACACAGGATGAGGAGGTGGCGTCGGACAGTGATGAGTCCTGAGG | SEQ ID NO: 280 | Homo sapiens DNA segment on chromosome 21 (unique) 2056 expressed sequence (D21S2056E), mRNA [NM_003683] |
| 281 | A_23_P84782 | THAP4 | CACAGCCAATGACTCAGGCATCTCACGTCACCTACAGAGAGGTGACCCCGGTAAACCTAGA | SEQ ID NO: 281 | Homo sapiens THAP domain containing 4 (THAP4), mRNA [NM_015963] |
| 282 | A_23_P8848 | RC74 | CCAGCCTTTGGTTTCGTTACTTGCCTACAGTGCTGTAGGCAATAAGATGATGCCAA | SEQ ID NO: 282 | Homo sapiens integrator complex subunit 9 (RC74), mRNA [NM_018250] |
| 283 | A_23_P89835 | THC2619205 | AGCTATACATTCTTCTTCTGGTCGCATCTTAAACGTCTCTGTTGTGGTGCACGCCAAGA | SEQ ID NO: 283 | MARE2_HUMAN (Q15555) Microtubule-associated protein RP/EB family member 2 (APC-binding protein EB2) (End-binding protein 2) (EB2), partial (87%) [THC2619205] |
| 284 | A_23_P89884 | TRIM28 | AGTTTGCCGAGGATGATGGGCCGGACGATGTTCAAGGAATTCAACAAGTTAACTGAGGACAAGG | SEQ ID NO: 284 | Homo sapiens tripartite motif-containing 28 (TRIM28), mRNA [NM_005762] |
| 285 | A_23_P90089 | GCDH | GAATGGGATTTCTGCAGAGTATCACGTGATCCGGCAGGCGATGAACCTGGAGGGCGGTGAA | SEQ ID NO: 285 | Homo sapiens glutaryl-Coenzyme A dehydrogenase (GCDH), nuclear gene encoding mitochondrial protein, transcript variant 2, mRNA [NM_013976] |
| 286 | A_23_P91328 | NOL5A | GAGGTTCCTCAGGAGAATGGAAGACCGGATCTATCTCTTTCTCCAAACCAAGAAA | SEQ ID NO: 286 | Homo sapiens nucleolar protein 5A (56kDa with KKE/D repeat) (NOL5A), mRNA [NM_006392] |
| 287 | A_23_P93818 | DKFZP434A0131 | TTTGAATGAGAGTCTCATCTTGGCTAGGACGATGGGCGAACAACTGGGGAGGTGGAGGT | SEQ ID NO: 287 | Homo sapiens mRNA; cDNA DKFZp434A0131 (from clone DKFZp434A0131). [AL137492] |
| 288 | A_23_P9415 | ACO1 | AATTATACCAGTCTTAAGTGACATAGAAGATAAGAAGTTTGCACACTTCAAATCAGAGCAGTG | SEQ ID NO: 288 | Homo sapiens aconitase 1, soluble (ACO1), mRNA [NM_002197] |
| 289 | A_23_P9416 | ACO1 | TACCGTCGTTATTGTTCCTCTTACGGCTCTGCCTCAATGAAAACTTCCTCTTGAGGGTCATTT | SEQ ID NO: 289 | Homo sapiens aconitase 1, soluble (ACO1), mRNA [NM_002197] |

Fig. 1-17

| No. | Probe ID No. | Symbols of genes | Sequence | SEQ ID NO: | Descriptions of genes (letters and numbers within ( ) indicate GenBank accession No.) |
|---|---|---|---|---|---|
| 290 | A_23_P9426 | GOLGA2 | CCTTGTCAGTCAAGCGCTTACGCTTACAGTAGGAAGCATAGACCGCGTGTCAACGGGGGT | SEQ ID NO: 290 | Homo sapiens golgi autoantigen, golgin subfamily a, 2 (GOLGA2), mRNA [NM_004486] |
| 291 | A_23_P98863 | FAF1 | GCGTTTGCTGGCGAGCAACAAGGCTCAGAATGTCGTTTGATTTTGTAGGTTGCAAAGGATT | SEQ ID NO: 291 | Homo sapiens Fas (TNFRSF6) associated factor 1 (FAF1), mRNA [NM_007051] |
| 292 | A_23_P97274 | SCAMP3 | TGCCAGGCTTTCAGAAGGGCCAAGGCCAAGAATTTGCTGCGTGGTGTCTTCTCAAGCCTGCGGT | SEQ ID NO: 292 | Homo sapiens secretory carrier membrane protein 3 (SCAMP3), transcript variant 2, mRNA [NM_052837] |
| 293 | A_23_P97736 | NCDN | GGTTGGTTGAAGGGACGGAGAGTCTTTGGGCCCAGATCTTTAAACCTTTGTCTGTGTTG | SEQ ID NO: 293 | Homo sapiens neurochondrin (NCDN), transcript variant 3, mRNA [NM_014284] |
| 294 | A_23_P9823 | MLXIP | TCTTGTTGTTGTATGAGGTTTCTTGTTTGGAATGTGTGCCTGATGAATCCAGGCCAGGACCAAGG | SEQ ID NO: 294 | Homo sapiens MLX interacting protein (MLXIP), mRNA [NM_014938] |
| 295 | A_23_P98252 | ARL2 | TGCCGGGCATCGACTGGCTGCTGGATGACATTTCCAGCCGCATTTTCAGAGGTGACTGAA | SEQ ID NO: 295 | Homo sapiens ADP-ribosylation factor-like 2 (ARL2), mRNA [NM_001667] |
| 296 | A_23_P98645 | DCHS1 | GTTGCTCACTGACCTGTGACCAGGTCCAATGTGGGGACAAATATGAAGGAGGTAGGAGCC | SEQ ID NO: 296 | Homo sapiens dachsous 1 (Drosophila) (DCHS1), mRNA [NM_003737] |
| 297 | A_24_P100234 | MORC2 | TGAATTCAGATGAGCTAATATCTTTTCGTCTGAAGGAGTACTTCAAGGAATATGAAGTAG | SEQ ID NO: 297 | Homo sapiens MORC family CW-type zinc finger 2 (MORC2), mRNA [NM_014941] |
| 298 | A_24_P101402 | NOL5A | GGCTGGCAAGACAGCTCCAAGAAGAAGACTAAAAGTTCCAATAAAGCATGCCAGGAGATTA | SEQ ID NO: 298 | Homo sapiens nucleolar protein 5A (56kDa with KKE/D repeat) (NOL5A), mRNA [NM_006392] |
| 299 | A_24_P101426 | A_24_P101426 | GTTTATGAGTCGGACCAAACAGCCACCTGTCTGCCTTTGCCAGATGATCCGATGATGAA | SEQ ID NO: 299 | |
| 300 | A_24_P102512 | CABIN1 | CTCCTGTGGGTGATATTTCTGGGGGAGATAAATCCAAGAAAGGGGTAAAACGAAGAAGA | SEQ ID NO: 300 | Homo sapiens calcineurin binding protein 1 (CABIN1), mRNA [NM_012295] |
| 301 | A_24_P105633 | VIPR1 | TCTGATAGGAATGTGAAAGCACGGACTCTTAGTGCTAAGTTTTGTGTATCGTAACCAGCC | SEQ ID NO: 301 | Homo sapiens vasoactive intestinal peptide receptor 1 (VIPR1), mRNA [NM_004624] |
| 302 | A_24_P110719 | ZNF236 | AGTTCTCAGAGACTGCTGCTGTTTTAAGCGGCCACACTTTTCAGAGTTACCTCTTCAA | SEQ ID NO: 302 | Homo sapiens zinc finger protein 236 (ZNF236), mRNA [NM_007345] |
| 303 | A_24_P119337 | AK054562 | GCAGTTGCAGTTAGGACCACACTAAAAGGTTAATGTCCACGCGTGTTGACCAAGCCCT | SEQ ID NO: 303 | Homo sapiens mRNA for FLJ00054 protein, partial cds. [AK054562] |
| 304 | A_24_P127701 | LOC441616 | CCAGGTGATGGATAGTCAGACGGACATGGTGCAGCAGAGATCCGGGCTCTAGAGCAACAAT | SEQ ID NO: 304 | PREDICTED: Homo sapiens similar to Protein C11orf2 (Another new gene 2 protein) (LOC441616), mRNA [XM_001129707] |
| 305 | A_24_P128001 | ZNF395 | GAATTCTTTGCTTTCTAAACTGTTCCAGAAAGGACTGTGAGCAAGATGAATTTACTTTTG | SEQ ID NO: 305 | Homo sapiens zinc finger protein 395 (ZNF395), mRNA [NM_018660] |
| 306 | A_24_P128057 | MBNL1 | AGAATATTGCTGCAACACTATCTGTGATTGGTTATCTCTCTATCATGGATTGCTTGACAA | SEQ ID NO: 306 | Homo sapiens muscleblind-like (Drosophila) (MBNL1), mRNA (cDNA clone IMAGE:3935812), partial cds. [BC005296] |
| 307 | A_24_P142289 | HIRIP3 | GAGAGGAAGAACCGCTCTTCCAAGAAGAGCTCAGGAAAGCAGGACACGAAGGCTCCTCT | SEQ ID NO: 307 | Homo sapiens HIRA interacting protein 3 (HIRIP3), mRNA [NM_003609] |
| 308 | A_24_P142963 | PIK4CA | TGACTCTCATGTTGGACAGGGGCCTGCCCGTGTTTTCGGCGGCCAGACAATCAAGGCTCTTGA | SEQ ID NO: 308 | Homo sapiens phosphatidylinositol 4-kinase, catalytic, alpha polypeptide (PIK4CA), transcript variant 1, mRNA [NM_002650] |

Fig. 1-18

| No | Probe ID No. | Symbols of genes | Sequence | SEQ ID NO: | Descriptions of genes (letters and numbers within [ ] indicates GenBank accession No.) |
|---|---|---|---|---|---|
| 309 | A_24_P144601 | POU5F1 | AACAATGAAAATCTTCAGGAGATATGCAAAGCAGAAAGCCTGGTGGAGGCCGAAAGAGA | SEQ ID NO: 309 | Homo sapiens POU domain, class 5, transcription factor 1 (POU5F1), transcript variant 1, mRNA [NM_002701] |
| 310 | A_24_P145047 | ZNF609 | AGTATTTAAACGTGCCTGCGTGGGAGTTAGGACGGATGGTTTCCGATGAAAGTTAGGAATGACGGGAAAAGTACC | SEQ ID NO: 310 | Homo sapiens zinc finger protein 609 (ZNF609), mRNA [NM_015042] |
| 311 | A_24_P147910 | SEPT9 | GTCCATCACGGCAGGATATTGAGGAGAAAAGGGTCCGAGATGAAAGCTGACAGTGATTGACAC | SEQ ID NO: 311 | Homo sapiens septin 9 (SEPT9), mRNA [NM_006640] |
| 312 | A_24_P158567 | CRY2 | CACCACGACGTCGTGCCAGTGACAGGCACAGCTGACACCCAGGCAGGGAAACCATCTAGTCTTT | SEQ ID NO: 312 | Homo sapiens cryptochrome 2 (photolyase-like) (CRY2), mRNA [NM_021117] |
| 313 | A_24_P165042 | IMPDH2 | TTGGACTCTTCCCAGGGAAATTCCATCTTCCAGATCAATATGATCAAGTACATCAAAGAC | SEQ ID NO: 313 | Homo sapiens IMP (inosine monophosphate) dehydrogenase 2 (IMPDH2), mRNA [NM_000884] |
| 314 | A_24_P166645 | REPIN1 | CCCGTGCGTAGGCACCCAGACTTGGAGAGACCCGTCTGCTGTTAATACTTGCATCCTCTT | SEQ ID NO: 314 | Homo sapiens replication initiator 1 (REPIN1), transcript variant 2, mRNA [NM_014374] |
| 315 | A_24_P169645 |  | AAGTTGTGGTGAAGAGGTTATTTATGAGTTGCACCAAATGGCCATCTCTGTCTCTTTCCT | SEQ ID NO: 315 |  |
| 316 | A_24_P171345 | PUM1 | GAGCACAGGTCGTCCTGAGGATAAAAGCAAAATTGTAGCAGAAATCCGAGGCAATGTACTT | SEQ ID NO: 316 | Homo sapiens pumilio homolog 1 (Drosophila) (PUM1), transcript variant 2, mRNA [NM_014676] |
| 317 | A_24_P181108 | WDR74 | TGGGTTGCAGTCGCACCCTTCAAAGCCTACAGTAGCCTCCTGTGGCTTGGACAGAGTCTT | SEQ ID NO: 317 | Homo sapiens WD repeat domain 74 (WDR74), mRNA [NM_018093] |
| 318 | A_24_P185158 | FAM134C | GCCGGTAGTAGCAAATCATGTGTAGTGTTGAGAGAGAAACCTAAACATGGTACTTGATTGTAAAC | SEQ ID NO: 318 | Homo sapiens hypothetical protein LOC162427 (LOC162427), mRNA [NM_178126] |
| 319 | A_24_P191067 | CLSTN1 | ACCGACATAGGACTTTGCTCTTGGTTACATGTAAAATTTTAGATTTCTAAAACAGGTGGG | SEQ ID NO: 319 | Homo sapiens calsyntenin 1 (CLSTN1), transcript variant 1, mRNA [NM_001009566] |
| 320 | A_24_P193570 | CNOT1 | AGAGTTCGTTGTGATTACCATTATGGGTCTGTGATGTGATCCCACCTAATTGTATGCA | SEQ ID NO: 320 | Homo sapiens CCR4-NOT transcription complex, subunit 1 (CNOT1), transcript variant 1, mRNA [NM_016284] |
| 321 | A_24_P196298 | MLL | GCACTTTGAACATCCTCAGCACTCTCTCCAATGGCAATAGTTGTAAGCAAAAATTCCAG | SEQ ID NO: 321 | Homo sapiens myeloid/lymphoid or mixed-lineage leukemia (trithorax homolog, Drosophila) (MLL), mRNA [NM_005933] |
| 322 | A_24_P200694 | RING1 | GAAATTCTGGAAGGTGTCCGCGGCCACTGGAGGCTGTGTATGCTCCCACCAAGGATGCAAA | SEQ ID NO: 322 | Homo sapiens ring finger protein 1 (RING1), mRNA [NM_002931] |
| 323 | A_24_P2093 | XAB2 | ACGTGAGGAAGGACTTTGAGGTCCGGGATGGGCAATGAGGACGACATCAAGGAAATGCTGGGT | SEQ ID NO: 323 | Homo sapiens XPA binding protein 2 (XAB2), mRNA [NM_020196] |
| 324 | A_24_P212764 | A_24_P212764 | GTCGCGACTTGTGGGCAGAGGAGTTCTAGACCAGGTTGTCTCCTGGGAGCATTGACAC | SEQ ID NO: 324 |  |
| 325 | A_24_P213175 | A_24_P213175 | TTTCGCCTGAGAGCTGACAGTAGCAATGTTGTTTCAGAGAGCCCATTTGCACAGGTTTCA | SEQ ID NO: 325 |  |
| 326 | A_24_P214841 | POU5F1 | AATCTTCAGGAGATATGCAAAGCAGAAACCCTCGTGCAGAGGCCGAAAGAGAAAGCGAACC | SEQ ID NO: 326 | Homo sapiens POU domain, class 5, transcription factor 1 (POU5F1), transcript variant 1, mRNA [NM_002701] |

Fig. 1-19

| No. | Probe ID No. | Symbols of genes | Sequence | SEQ ID NO: | Descriptions of genes (letters and numbers within [ ] indicates GenBank accession No.) |
|---|---|---|---|---|---|
| 327 | A_24_P216087 | PAF1 | GACGATGCGCACTCTGATGATGAGGACAAGAGGACAAGGCCAAGGTGGGCAGTGAGAATGAT | SEQ ID NO: 327 | Homo sapiens Paf1, RNA polymerase II associated factor, homolog (S. cerevisiae) (PAF1), mRNA [NM_019088] |
| 328 | A_24_P221668 | AW172689 | GGAGGTCTGGGATGTCTGATTATATCTGATTTCTGAGCTCTGGGCATGGAGGTCTGTCTG | SEQ ID NO: 328 | xj79h10.x1 Soares_NFL_T_GBC_S1 Homo sapiens cDNA clone IMAGE:2663491 3' similar to TR:O13116 Q13116 MEMBRANE PROTEIN-LIKE PROTEIN ;, mRNA sequence [AW172689] |
| 329 | A_24_P224926 | MFNG | AGAACAATCATCCACAGACGTATTCCGTCGAAGCATCGTGGTTCTGTAGAAAAATTAAATGCTTA | SEQ ID NO: 329 | Homo sapiens MFNG O-fucosylpeptide 3-beta-N-acetylglucosaminyltransferase (MFNG), mRNA [NM_002405] |
| 330 | A_24_P231132 | ACVR2B | CTGTCACCAATGTGGACCTGCCCGTAAAGAGTCAAGCATCTAAGCCGAGGACATGAGTG | SEQ ID NO: 330 | Homo sapiens activin A receptor, type IIB (ACVR2B), mRNA [NM_001106] |
| 331 | A_24_P231173 | PERQ1 | CCCTACTTGGGTTCGTCTCCGGCCACATTTTGGGTTTTGTAACAGTTTTGTCTTTTGGGTTT | SEQ ID NO: 331 | Homo sapiens PERQ amino acid rich, with GYF domain 1 (PERQ1), mRNA [NM_022574] |
| 332 | A_24_P235131 | TRIAD3 | TCCAGTATCCCCCATGTGAAGGTCACTTCCCTTCCTTCATGGAGTCAGGTGAAGCATCAGCTC | SEQ ID NO: 332 | Homo sapiens TRIAD3 protein (TRIAD3), transcript variant 1, mRNA [NM_207111] |
| 333 | A_24_P238215 | DKFZP566P0123 | TTGAAAACACAGATTCCCCATCTGGAATTTTGAACAGCAGTCAAGCCTATCAAAAGAGG | SEQ ID NO: 333 | Homo sapiens hypothetical protein (DKFZP566P0123), mRNA [NM_015531] |
| 334 | A_24_P241862 | RANBP3 | TGCTCAGACTCAATGACATGGCGTCCACCGATGACGGCAGACTACAGTCCGAGTCAGTGA | SEQ ID NO: 334 | Homo sapiens RAN binding protein 3 (RANBP3), transcript variant RANBP3-b, mRNA [NM_007320] |
| 335 | A_24_P244575 | TPCN1 | CCCTTTGAGAAAGACAACACATTATTGAGACTCACTGTGTGATTCCCGCGGGAGTCAGACTGG | SEQ ID NO: 335 | Homo sapiens mRNA for KIAA1169 protein, partial cds. [AB032995] |
| 336 | A_24_P245246 | PIP5K2B | TTTGAGACCGTGTTACTGTTGAAAATGCATGCATGGTTACGATGAATCGAACCTGAGG | SEQ ID NO: 336 | Homo sapiens phosphatidylinositol-4-phosphate 5-kinase, type II, beta (PIP5K2B), mRNA [NM_003559] |
| 337 | A_24_P248053 | TOP1MT | GCAGGAGAAGACTTTGAATCTAACGACGAGCGGTGTTGAAAGTTGTTTGTATGTGTGT | SEQ ID NO: 337 | Homo sapiens topoisomerase (DNA) I, mitochondrial (TOP1MT), nuclear gene encoding mitochondrial protein, mRNA [NM_052963] |
| 338 | A_24_P250333 | SNRPA | CAGCTCGCGATGCCCTGCAGGGCTTTAAGATCACGCAGAGAAGACAGCCATGAAGATCTCCT | SEQ ID NO: 338 | Homo sapiens small nuclear ribonucleoprotein polypeptide A (SNRPA), mRNA [NM_004596] |
| 339 | A_24_P251688 | ABCF3 | TTGGGGACAGGCTTATTCCCAAATGTCTCTATCCTTTTGACTGGAGGCATCTCTGCACAA | SEQ ID NO: 339 | Homo sapiens ATP-binding cassette, sub-family F (GCN20), member 3 (ABCF3), mRNA [NM_018358] |
| 340 | A_24_P252130 | PPARD | GGTGAGGATACAGCTCTTCTCAGTGTGTGAACAATCCAAAATTGAAATGTATATTTT | SEQ ID NO: 340 | Homo sapiens peroxisome proliferator-activated receptor delta (PPARD), mRNA [NM_006238] |
| 341 | A_24_P254437 | THC2663227 | GGGAGGGCACTGTCTCTTTTTCTCTCATTTTTAAAATGAAGTGTTGTTGGCTTTGTAT | SEQ ID NO: 341 | CA312433 UI-CF-FNO-afk-i-18-0-UI.s1 UI-CF-FNO Homo sapiens cDNA clone UI-CF-FNO-afk-i-18-0-UI 3', mRNA sequence [CA312433] |
| 342 | A_24_P256063 | LOC442249 | CTCAGGACCATTCCAAGATCCAAGATCATGGCAGAGACATCCAGGCCCAATATAACGAAGCTCTCTCGGA | SEQ ID NO: 342 | PREDICTED: Homo sapiens hypothetical LOC442249 (LOC442249), mRNA [XR_019231] |
| 343 | A_24_P258846 | NFATC1 | CTCTCGGTCGTTGAGATCCGGCCATTTCGGAATCAGGAGGATAACCAGCCCCCGGTTCACGTCA | SEQ ID NO: 343 | Homo sapiens nuclear factor of activated T-cells, cytoplasmic, calcineurin-dependent 1 (NFATC1), transcript variant 1, mRNA [NM_172390] |

Fig. 1-20

| No. | Probe ID No. | Symbols of genes | Sequence | SEQ ID NO: | Descriptions of genes (letters and numbers within [ ] indicates GenBank accession No.) |
|---|---|---|---|---|---|
| 344 | A_24_P28170 | VPRBP | GGAGACTGACAGCTCTGAAGAAGTGTGATTTGGAAGATGAGATGAT CTTATCTCTGAATGA | SEQ ID NO: 344 | Homo sapiens Vpr (HIV-1) binding protein (VPRBP), mRNA [NM_014703] |
| 345 | A_24_P266728 | SF1 | GGTTCGTTTTATGTTTGTTTTAATCGCAAATGTCTGAATGTTTT GGCAGTGTGTAGGGGT | SEQ ID NO: 345 | Homo sapiens splicing factor 1 (SF1), transcript variant 1, mRNA [NM_004630] |
| 346 | A_24_P267452 | CD3EAP | ACAGTGAAGCAGGAACAGATTAAGACTGAGACGTCTAGAAGACAGA GTCGTGTCCCGGACC | SEQ ID NO: 346 | Homo sapiens CD3e molecule, epsilon associated protein (CD3EAP), mRNA [NM_012099] |
| 347 | A_24_P272594 | MAPKBP1 | GGGGTGTTTTAAGGTGGGCGTTTGTAGTGATGTATGAAGTTGTG AATAAACAGCAATTGT | SEQ ID NO: 347 | Homo sapiens mitogen activated protein kinase binding protein 1 (MAPKBP1), mRNA [NM_014994] |
| 348 | A_24_P273823 | NPAT | TGGCATTAGCCGGCATAGGACGCATAAGAGAAACTGAATGAGAAAA GAAAGTTTCTCCAAG | SEQ ID NO: 348 | Homo sapiens nuclear protein, ataxia-telangiectasia locus (NPAT), mRNA [NM_002519] |
| 349 | A_24_P294931 | PPP2R5D | TCACAGACATGGAAGGGAGGACGACCCTGGGGCTGACTGCTTTCTGT GGTGTTGGTTCCAA | SEQ ID NO: 349 | Homo sapiens protein phosphatase 2, regulatory subunit B', delta isoform (PPP2R5D), transcript variant 2, mRNA [NM_180876] |
| 350 | A_24_P29641 | NSUN5C | CAATAAAGACCAGTCACTTGGCTGCTCTTCTGAAAGAACCAAGGGA AGATCTTTGCCTTTG | SEQ ID NO: 350 | Homo sapiens NOL1/NOP2/Sun domain family, member 5C (NSUN5C), transcript variant 2, mRNA [NM_148936] |
| 351 | A_24_P298360 | LTBP3 | CTGCTGTTGGGGAAGCCCCCAAGAGATGAGGAGCAGTTCAGAGGGAG GATTCAGGAGAGTGT | SEQ ID NO: 351 | Homo sapiens latent transforming growth factor beta binding protein 3 (LTBP3), mRNA [NM_021070] |
| 352 | A_24_P307103 | tcag7.1017 | ATGTTTGGAATGCATGTGATGAGGCAGAAGAAGGATGGGCCC TGAGCCTGAGGAGAC | SEQ ID NO: 352 | Homo sapiens similar to Williams Beuren syndrome chromosome region 19 (MGC57359), mRNA [NM_001004351] |
| 353 | A_24_P312325 | C8orf15 | CTTGTTGAATGTGACTACTTTTAGTTGCGTGTCGAATATGAAGTAG AAAGCAGATTCTG | SEQ ID NO: 353 | Homo sapiens chromosome 8 open reading frame 15 (C8orf15), mRNA [NM_001033692] |
| 354 | A_24_P315564 | LOC646253 | AGCAAGATCAGGGCTCTACAGAGCAACATGCAAACCCTGGTCTATG AGAACTACAATAAGT | SEQ ID NO: 354 | PREDICTED: Homo sapiens similar to Protein C11orf2 (Another new gene 2 protein) (LOC646253), mRNA [XM_001130995] |
| 355 | A_24_P316414 | BC014346 | TAACGTTGGGGTCTTGGGAGTGGGGAGGATTCGTTAGCTTGAATAATTTA AGGGCTTGGCTGTA | SEQ ID NO: 355 | Homo sapiens, clone IMAGE:4042868, mRNA, partial cds. [BC014346] |
| 356 | A_24_P317927 | C9orf127 | AGCCTTCCGAAGACATGGATTCCTTCCCAGGGAGACAAAGCCCTG TCAGGAGCAGCAGCAT | SEQ ID NO: 356 | Homo sapiens chromosome 9 open reading frame 127 (C9orf127), transcript variant 1, mRNA [NM_001042590] |
| 357 | A_24_P321093 | SPOCK2 | CTGGAAGAAGCTTAAGCATGTGTTCAAAGAACGGTTTCTTGCTTG CTTGGTCCTGGGAACT | SEQ ID NO: 357 | Homo sapiens sparc/osteonectin, cwcv and kazal-like domains proteoglycan (testican) 2 (SPOCK2), mRNA [NM_014767] |
| 358 | A_24_P322847 | POLR3H | ACATGCCTGGGTCCCTGGGCTGCTGATGACTGATTAGTCTCTTCTGTCAC AGGGGTGCCTGGAGA | SEQ ID NO: 358 | Homo sapiens polymerase (RNA) III (DNA directed) polypeptide H (22.9kD) (POLR3H), transcript variant 4, mRNA [NM_001018051] |
| 359 | A_24_P32295 | C19orf36 | TTAAGGTGTCTGGAGGCCCCACACTTGGCCAACCTGACCTTGGAA GATGCTGCTGAGTGT | SEQ ID NO: 359 | Homo sapiens chromosome 19 open reading frame 36 (C19orf36), transcript variant 3, mRNA [NM_001039846] |
| 360 | A_24_P323628 | FLJ45655 | ATTGAGGAAGACGGCACGGAAAGCGAAGGAAGCTGGTGCTGCGTCC TAAAGGGGAAGCCAA | SEQ ID NO: 360 | Homo sapiens hypothetical protein LOC644128, mRNA (cDNA clone IMAGE:6158500), [BC064938] |

Fig. 1-21

| No. | Probe ID No. | Symbols of genes | Sequence | SEQ ID NO: | Descriptions of genes (letters and numbers within [ ] indicates GenBank accession No.) |
|---|---|---|---|---|---|
| 361 | A_24_P32646 | LOC648644 | AGATCGTGATCGCTCTGCAAGAGCAAGGCTGCTGGATCCTGCCCACTGTGTACCATGGCA | SEQ ID NO: 361 | PREDICTED: Homo sapiens similar to Aflatoxin B1 aldehyde reductase member 2 (AFB1-AR 1) (Aldoketoreductase 7) (LOC648644), mRNA [XR_018390] |
| 362 | A_24_P327815 | STIP1 | CACCAAACTGCTGGAGTTCCAGCTGGGACTCAAGGACTGTGAGGAATGTATGCAGCTGGA | SEQ ID NO: 362 | Homo sapiens stress-induced-phosphoprotein 1 (Hsp70/Hsp90-organizing protein) (STIP1), mRNA [NM_006819] |
| 363 | A_24_P329839 | VPS11 | CGTCATCAGGGACTACCTGGTCCAAAAACTACAGAAACAGAGCCAGGAGATTGCACAGGA | SEQ ID NO: 363 | Homo sapiens vacuolar protein sorting 11 homolog (S. cerevisiae) (VPS11), mRNA [NM_021729] |
| 364 | A_24_P335358 | PUS1 | CCTGGAGTTTGCGGTGATCAGGTGAAGGGCCAGAGCTTCATGATGGATCAGATCCGGAA | SEQ ID NO: 364 | Homo sapiens pseudouridylate synthase 1 (PUS1), transcript variant 1, mRNA [NM_025215] |
| 365 | A_24_P338892 | EDC3 | TTGGCCAAAATGTGAGGAGCAGTCTAGGTTACAGGGCTTTTTGGTAGGTAGGTTCTGGCTG | SEQ ID NO: 365 | Homo sapiens enhancer of mRNA decapping 3 homolog (S. cerevisiae) (EDC3), mRNA [NM_025083] |
| 366 | A_24_P340881 | LOC402149 | CTACGTGCGGACCATCATCAAGAAGAAGGCTGGAGCCAAAGTCAGCAGCATCAGATACAT | SEQ ID NO: 366 | PREDICTED: Homo sapiens similar to ribosomal protein L28 (LOC402149), mRNA [XR_019242] |
| 367 | A_24_P349002 | POM121 | AGGTAAATTAATGAACCATATATTTTAAAATCCTATTTTTCCCAAACAGGGCCCTCTGCAG | SEQ ID NO: 367 | Homo sapiens POM121 membrane glycoprotein (rat) (POM121), mRNA [NM_172020] |
| 368 | A_24_P350644 | ENST00000320547 | CATGTAGACACAGATATTTGAAAGGGCAGACGATGGCTAGAGGTGTAATGTGCAGCTTGTT | SEQ ID NO: 368 | Uncharacterized protein KIAA0515 [Source:Uniprot/SWISSPROT;Acc:Q5JSZ5] [ENST00000320547] |
| 369 | A_24_P356 | AAK1 | GCGGCTTATGTTCTGAATTTGTTTATGAGACTGATCATTAGTGAGACTGGCCACGTAT | SEQ ID NO: 369 | AP2-associated protein kinase 1 (EC 2.7.11.1) (Adaptor-associated kinase 1). [Source:Uniprot/SWISSPROT;Acc:Q2M2I8] [ENST00000360555] |
| 370 | A_24_P364970 | DHX33 | ATTTAATTCAGAAGGCAAGTAATCTTTCCCCAGATAATATTTGCCCGTAGAAGAGACCG | SEQ ID NO: 370 | Homo sapiens DEAH (Asp-Glu-Ala-His) box polypeptide 33 (DHX33), mRNA [NM_020162] |
| 371 | A_24_P369263 | MMS19L | TTCTACTGGAAGGCACCCCAAGTCATGAGTCTTCACGTGGACACCGTCGTCACGCAAGTTTG | SEQ ID NO: 371 | Homo sapiens MMS19-like (MET18 homolog, S. cerevisiae) (MMS19L), mRNA [NM_022362] |
| 372 | A_24_P371670 | HNRPA0 | AGTTCTGCGCAGTTTGGCACGGTGGACAAGAGGCCGAGATTATCGCGACAAGCAGTCCGGCA | SEQ ID NO: 372 | Homo sapiens heterogeneous nuclear ribonucleoprotein A0 (HNRPA0), mRNA [NM_006805] |
| 373 | A_24_P372613 | APBB1 | AAACCTGTTGGGGTAGATGTGATTAATGAGGCCCTCGAGTCAGTCGTGTCCTCCAGCAGC | SEQ ID NO: 373 | Homo sapiens amyloid beta (A4) precursor protein-binding, family B, member 1 (Fe65) (APBB1), transcript variant 1, mRNA [NM_001164] |
| 374 | A_24_P373312 | NFATC3 | GAACCAGAAGATCGGAGGAGGGTAACTTGGAACCATTGGTCTGCGAGGACATGACTTTAGAT | SEQ ID NO: 374 | Homo sapiens nuclear factor of activated T-cells, cytoplasmic, calcineurin-dependent 3 (NFATC3), transcript variant 4, mRNA [NM_173164] |
| 375 | A_24_P375592 | PHF20 | GGAGCCCAGGATTGAAAACAAAATGTTAAAATGCCAACATTTGTGTTAATTCTAGCTAC | SEQ ID NO: 375 | Homo sapiens cDNA FLJ33479 fis, clone BRAMY2002739. [AK090798] |
| 376 | A_24_P376422 | BC035371 | GAGGCAAGTTTGCATTTTGACACGGCATCTCACACTCCTGTGACGTCTCAACTTGGAGG | SEQ ID NO: 376 | Homo sapiens HSPC047 protein, mRNA (cDNA clone MGC:34368 IMAGE:5178752), complete cds. [BC035371] |

Fig. 1-22

| No. | Probe ID No. | Symbols of genes | Sequence | SEQ ID NO: | Descriptions of genes (letters and numbers within [ ] indicate GenBank accession No.) |
|---|---|---|---|---|---|
| 377 | A_24_P392765 | NHP2L1 | TACGTGTTCAAGTGATCAAGGGGTTTCATTTCGTCTTGGGGGATT AGGTATCATTGGGG | SEQ ID NO: 377 | Homo sapiens NHP2 non-histone chromosome protein 2-like 1 (S. cerevisiae) (NHP2L1), transcript variant 1, mRNA [NM_005008] |
| 378 | A_24_P384779 | PRKAG2 | CCATAAATGACAGCCAGGTGAGGGCAGAAATGGTGAGGGCAGAATAGGA AATGGAAATACACAA | SEQ ID NO: 378 | Homo sapiens cDNA FLJ90194 fis, clone MAMMA1001284. [AK074675] |
| 379 | A_24_P399038 | WDR46 | TAGAGCACCAGGTGAAGATCTTTGACTTGCGAGGGACGTACCAGC CTCTGAGCACTCGGA | SEQ ID NO: 379 | Homo sapiens WD repeat domain 46 (WDR46), mRNA [NM_005452] |
| 380 | A_24_P38844 | CCDC86 | TTCTCCCAGATCGTTCAGGACAAGCGCGTGCGCACATGGTGGCAG CGGAAGATGAAGGAA | SEQ ID NO: 380 | Homo sapiens coiled-coil domain containing 86 (CCDC86), mRNA [NM_024098] |
| 381 | A_24_P391526 | MAGED1 | GCTGAGATTCATTGCAGAGGTTCAGAAAGAGACCCTGGTGACTG GACTGCACAGTTCAT | SEQ ID NO: 381 | Homo sapiens melanoma antigen family D, 1 (MAGED1), transcript variant 1, mRNA [NM_001005333] |
| 382 | A_24_P396197 | PRKCSH | AGCCGGTCGGTGAAGGACGATGGAGGAGGTCCATCAGGAACGTGGAGC AAGAGATTCTTTG | SEQ ID NO: 382 | Homo sapiens protein kinase C substrate 80K-H (PRKCSH), transcript variant 1, mRNA [NM_002743] |
| 383 | A_24_P399065 | NUDT16L1 | GCCAGGTCGTCGTTTGCCCTCAAGGTGCTCAACATGATGCCCGGAGG AGAAGGCTGGTTGAGG | SEQ ID NO: 383 | Homo sapiens nudix (nucleoside diphosphate linked moiety X)-type motif 16-like 1 (NUDT16L1), mRNA [NM_032349] |
| 384 | A_24_P40010 | RPS28 | GCGGCGGCCATGATGGACCAGGCCGTGTGCAGCCGTATCGAAGCTGG CCAGGGTCACGAAGG | SEQ ID NO: 384 | Homo sapiens ribosomal protein S28 (RPS28), mRNA [NM_001031] |
| 385 | A_24_P401521 | A_24_P401521 | CAAGTTAAGTATCTCCTGGCTATGGTCAAGCGTATTTTAGGCGGGGC CAGACCCTTCCCTG | SEQ ID NO: 385 | |
| 386 | A_24_P401637 | AK095727 | CGGGGGGGCTTCCTCCCTTCTTAGAAGTCAGGTCATGCATATATTTG ATCTGGCGTTGCCAG | SEQ ID NO: 386 | Homo sapiens cDNA FLJ38408 fis, clone FEBRA2009029. [AK095727] |
| 387 | A_24_P465621 | NISCH | TGAAGTCCAGTGCAGGTGGCAGGTGTTGTCCCCAGTGCTGAGAGCAGAGA GAAGCTCATCTCGCT | SEQ ID NO: 387 | Homo sapiens nischarin (NISCH), mRNA [NM_007184] |
| 388 | A_24_P409881 | LOC338756 | CAGGAGGTTCCTCAGGAGAGAAACAGAAGACCCATGCTATCTCTTTC TGCAAACCCAAGAAA | SEQ ID NO: 388 | PREDICTED: Homo sapiens similar to nucleolar protein 5A (LOC338756), mRNA [XM_291989] |
| 389 | A_24_P412976 | TMEM143 | TTATTGGTCTATCAATTTCTGCCGTCTGGTGTCCCAAAGTAATAA ATCATGTTTAATAAG | SEQ ID NO: 389 | Homo sapiens transmembrane protein 143 (TMEM143), mRNA [NM_018273] |
| 390 | A_24_P416289 | KIAA0195 | GGGCTAAAGCAGACCCATTTCTGAACAGGGGAGTTTGTATCATG AATGTTTCCAGGTTT | SEQ ID NO: 390 | Homo sapiens KIAA0195 (KIAA0195), mRNA [NM_014738] |
| 391 | A_24_P42136 | KRT18 | GCTCACAGAGCTGAGACAGCATACAGTCCAGTCTTGGAGATCGACCT GGACTCCTTGAGAA | SEQ ID NO: 391 | Homo sapiens keratin 18 (KRT18), transcript variant 1, mRNA [NM_000224] |
| 392 | A_24_P42569 | BC030138 | AGCTTGCTTGCTGATGAACACTTCCACAGTCGTTTTGAGCTAAGTA GTTTTTGTAATTAGT | SEQ ID NO: 392 | Homo sapiens cDNA clone IMAGE:4335164, partial cds. [BC030138] |
| 393 | A_24_P44514 | CIB1 | CCATTATGCGTTCCGCATGTTTGACTTTGATGATGACGGGAACCTT GAACAGAAGACACCT | SEQ ID NO: 393 | Homo sapiens calcium and integrin binding 1 (calmyrin) (CIB1), mRNA [NM_006384] |
| 394 | A_24_P44891 | TNPO2 | GATGGTCCTCAACAACCTGGTGGAAATCATTAACGGACGGACGAGAC ACCCAAGAACACTGGT | SEQ ID NO: 394 | Homo sapiens transportin 2 (importin 3, karyopherin beta 2b) (TNPO2), mRNA [NM_013433] |
| 395 | A_24_P460763 | AK022443 | GTGAGTAGGACAGGGTACTTAAGATGCCTAGTGGGTGTAAATGTGAA ATGCTATTGGCAGAT | SEQ ID NO: 395 | Homo sapiens cDNA FLJ12381 fis, clone MAMMA1002566. [AK022443] |

Fig. 1-23

| No | Probe ID No. | Symbols of genes | Sequence | SEQ ID NO: | Descriptions of genes (letters and numbers within [ ] indicates Gen-Bank accession No.) |
|---|---|---|---|---|---|
| 396 | A_24_P477127 | PKD1 | CCAGATACGGAAGAACATCACGGAGACTCTGGTGTCCCCTGAGGGTCCACACGTGGATGA | SEQ ID NO: 396 | Homo sapiens polycystic kidney disease 1 (autosomal dominant) (PKD1), transcript variant 2, mRNA [NM_000296] |
| 397 | A_24_P481783 | LOC390595 | GCATCTAGGCCCAATGCCAGACGTGGCAAGCCATCCTAAGTGTATTATTAAAACGAAGTA | SEQ ID NO: 397 | Homo sapiens cDNA FLJ13740 fis, clone PLACE3000199. [AK023802] |
| 398 | A_24_P51350 | LARS | GAAAAGAGAAAATAGAGCGTGTATGGTTGCCCCCCTGATTTCAGATGAAGAAGGAAGA | SEQ ID NO: 398 | Homo sapiens leucyl-tRNA synthetase (LARS), mRNA [NM_020117] |
| 399 | A_24_P529786 | AK091744 | GATACATAACAGGACAATACAAATATTATCACATACGGTCAATTTATTTGTGAATATTGAA | SEQ ID NO: 399 | Homo sapiens cDNA FLJ34425 fis, clone IHDPC2008297. [AK091744] |
| 400 | A_24_P648264 | AL512741 | AAGAATTGAGTTAGAACTGCCGTATAATGTAATGCAGAATATTTCGCAATAATGCGTAGG | SEQ ID NO: 400 | Homo sapiens mRNA; cDNA DKFZp667N064 (from clone DKFZp667N064). [AL512741] |
| 401 | A_24_P55719 | SURF5 | GTCAAGCGTTTGCGAAGCTAATGACCTGGCTCTGTGCGAAGGTTACGGGAGGCTGGACGT | SEQ ID NO: 401 | Homo sapiens surfeit 5 (SURF5), transcript variant b, mRNA [NM_133640] |
| 402 | A_24_P55971 | VEGFB | CACTGGGGACACCAAGAAGTCCGGATGCAGATGCAGATCCGGTACCCGAAGCAGTCAGGT | SEQ ID NO: 402 | Homo sapiens vascular endothelial growth factor B (VEGFB), mRNA [NM_003377] |
| 403 | A_24_P5743 | ALDH16A1 | CTTGCACCAAGAGCTCAGGTCAGATCCTGATGGTATTTCGGATCAGACCAGGGTTCCCAGTTTGT | SEQ ID NO: 403 | Homo sapiens aldehyde dehydrogenase 16 family, member A1 (ALDH16A1), mRNA [NM_153329] |
| 404 | A_24_P583330 | THC2657163 | GTAAGCAGTCATTATAATTTGTTGATGATAGTTTAAGTATATGGGGTATGCCCATTAGCC | SEQ ID NO: 404 | |
| 405 | A_24_P562421 | AL050185 | TTTTTTCTATACCCGTTTCATAGGACAGCTAATGAGACTGGATATGATTAAAAGCGTGA | SEQ ID NO: 405 | Homo sapiens mRNA; cDNA DKFZp586A0423 (from clone DKFZp586A0423). [AL050185] |
| 406 | A_24_P598516 | AK021595 | CTGAGTTCCTGATGATGTTCCTGGAGTTATCCTTTTCCTTATGATTTAAAAGTGTTTAGC | SEQ ID NO: 406 | Homo sapiens cDNA FLJ11533 fis, clone HEMBA1002678. [AK021595] |
| 407 | A_24_P611114 | hCG_1739474 | CTTTTGTTTATCAGGTACAGTAGCATGTTCATGGGCTAAGCATAGACATTAGTACCCAAAT | SEQ ID NO: 407 | Homo sapiens cDNA FLJ10133 fis, clone HEMBA1003067. [AK000995] |
| 408 | A_24_P63608 | NOLA2 | ATTGAGGTATACTGGCATCTCCCAGTCACTGTGTGAGGACGCGAAATTTGCCGTATGTCTAT | SEQ ID NO: 408 | Homo sapiens nucleolar protein family A, member 2 (H/ACA small nucleolar RNPs) (NOLA2), transcript variant 1, mRNA [NM_017838] |
| 409 | A_24_P636318 | LOC130074 | GGAAACTGCATGTTTCAGAAAGTTTGTCTCTTTTTCCTACTCATTATTTGAAGAAGACAG | SEQ ID NO: 409 | Homo sapiens p20 (LOC130074), mRNA [NM_001009993] |
| 410 | A_24_P636390 | AF009267 | TTGGGATATCACTGTGTGTGTACCGTGGAAGTCCTGGAGTGTGTTGGGTCCTCATCAGCAG | SEQ ID NO: 410 | Homo sapiens clone FBA1 Cri-du-chat region mRNA. [AF009267] |
| 411 | A_24_P6381 | SERINC5 | GGTCATTTTATGACGAGAAGAAAGGCACCGTCTACATCTACTGCTACTGCTACTGCTACTGTACTTCGCAGCTTCGTGTT | SEQ ID NO: 411 | Homo sapiens serine incorporator 5 (SERINC5), mRNA [NM_178276] |
| 412 | A_24_P55941 | C21orf96 | ATTGGGACTTCTCCCAGGATGTACTGAATTCAAGGAAGCTTCTCTAGGTTAGCAGAAA | SEQ ID NO: 412 | Homo sapiens cDNA: FLJ20856 fis, clone ADKA01509. [AK024509] |
| 413 | A_24_P662427 | AK022109 | GAAGCCCTTAAGGCATGTTTCCATAAGTGACATCTGATGCAGACGTCATCTTTCTGATATC | SEQ ID NO: 413 | Homo sapiens cDNA FLJ12047 fis, clone HEMBB1001983. [AK022109] |
| 414 | A_24_P864995 | AK055641 | TAAGCATTTATCTGTTTCCATAACTGACATCTGATGCAGACGTCATTCTCTCCCCGTCTT | SEQ ID NO: 414 | Homo sapiens cDNA FLJ31079 fis, clone HSYRA2001595. [AK055641] |
| 415 | A_24_P37784 | KIAA1666 | GGAACTCCAAGAGACTCCCACTGTGGACTCCAAAGACTGAAGACTGATGATAGCAGCTCTGAGACTATG | SEQ ID NO: 415 | Homo sapiens KIAA1666 protein, mRNA (cDNA clone IMAGE:4827837), complete cds. [BC035246] |

Fig. 1-24

| No. | Probe ID No. | Symbols of genes | Sequence | SEQ ID NO: | Descriptions of genes (letters and numbers within [ ] indicate GenBank accession No.) |
|---|---|---|---|---|---|
| 416 | A_24_P677890 | BC016364 | CCTTTGTAGCAGTTCCCAGGTTTTTCAGAAGAGTGGTGAATCCATGCCTTGGCAATCCT | SEQ ID NO: 416 | Homo sapiens, clone IMAGE:4703872, mRNA. [BC016364] |
| 417 | A_24_P690273 | AK024900 | TACCTGTGTGAGATAGTAGTATTGATGGTGAGACGTGAATAGTAAAATATCTTGAGGTA | SEQ ID NO: 417 | Homo sapiens cDNA: FLJ21247 fis, clone COL01205. [AK024900] |
| 418 | A_24_P69784 | PACS1 | AAGTTCCGTGATGAAGACTCCTATCAGAAGTTTATTCCCTTGATTGGCGTGGTGAAGGTG | SEQ ID NO: 418 | Homo sapiens phosphofurin acidic cluster sorting protein 1 (PACS1), mRNA [NM_018026] |
| 419 | A_24_P700170 | A_24_P700170 | ACGGCTGAACATCATCTCTAACCTGGACGTGTGTGAACGAGGGTGATTGGCATCCGGTCAGC | SEQ ID NO: 419 | |
| 420 | A_24_P706901 | BF895757 | TCTGGGCTCTGGAGAGTGACAAGACAAGCAGCCTTTGGCTTTGTAAGAAGTTGATCTAC | SEQ ID NO: 420 | BF895757 RC3-HT0162-221100-012-H03 HT0162 Homo sapiens cDNA, mRNA sequence [BF895757] |
| 421 | A_24_P713185 | THC2595309 | AATATGACTAGGTTACACAGAATAGGTCAGATAGTACAGATAGTCTTTACGGAGGTCCACTTA | SEQ ID NO: 421 | HMITCSEQ Hylobates lar complete mitochondrial DNA sequence, partial (3%) [THC2595309] |
| 422 | A_24_P713312 | THC2639056 | TTTATATGGTCGGATGCTCCATGTAGGATTAAGGGGTAATTAATAGTAATGTATGTGGA | SEQ ID NO: 422 | ALU8_HUMAN (P39195) Alu subfamily SX sequence contamination warning entry, partial (10%) [THC2639056] |
| 423 | A_24_P728115 | AK024937 | ACTGCATAGTCACTACTTTTAGTGAGTATGTGTTTAGGAGAGGCTATGTAAGTACCA | SEQ ID NO: 423 | Homo sapiens cDNA: FLJ21284 fis, clone COL01911. [AK024937] |
| 424 | A_24_P782337 | AK026477 | AGTCAAAGACCTTGCTGGTGAGAATGTAAGTTGTTAGGATTCTCTGAATCGGGAAGTTATA | SEQ ID NO: 424 | Homo sapiens cDNA: FLJ22824 fis, clone KAIA3991. [AK026477] |
| 425 | A_24_P801451 | EHMT2 | AAATCGGGACATCCGCACCGAGGAGAATCATTCTGCCGAGACCGTGGCTCGGGGCTATGA | SEQ ID NO: 425 | Homo sapiens euchromatic histone-lysine N-methyltransferase 2 (EHMT2), transcript variant NG36/69a, mRNA [NM_006709] |
| 426 | A_24_P83183 | WHSC2 | GACACTTTTTGGAGTCAAGCTCAACGTTACATTTTTGAATGTAGTAGTAAGTAATTAACCAAAAAGT | SEQ ID NO: 426 | Homo sapiens Wolf-Hirschhorn syndrome candidate 2 (WHSC2), mRNA [NM_005663] |
| 427 | A_24_P84984 | TTC3 | TGCGCGGTTCAAGGCCAGTCGTCCAAAAAGGCGTTCAATAGTATTATTGAACCACCTGTCAGT | SEQ ID NO: 427 | Homo sapiens tetratricopeptide repeat domain 3 (TTC3), transcript variant 1, mRNA [NM_003316] |
| 428 | A_24_P85283 | POLR3A | AAGATGAACCTTTGGAGTTTAAAAGGGGTCTGACAACATCAAAGCAGTCTTCCCGTGTG | SEQ ID NO: 428 | Homo sapiens polymerase (RNA) III (DNA directed) polypeptide A, 155kDa (POLR3A), mRNA [NM_007055] |
| 429 | A_24_P87763 | EEF2 | CATGTTTGTGGTCAAGGCCTACTCGCCGTCAACGAGTCGTTTGGCTTCACCGGCTGACCT | SEQ ID NO: 429 | Homo sapiens eukaryotic translation elongation factor 2 (EEF2), mRNA [NM_001961] |
| 430 | A_24_P87824 | ZMYND8 | GACGGTCAGCTCAGGAAAGCAAGGAGAGTGGCTCGACCCGCTTGACCTTTCTGGGTCCAGAGA | SEQ ID NO: 430 | Homo sapiens zinc finger, MYND-type containing 8 (ZMYND8), transcript variant 2, mRNA [NM_012408] |
| 431 | A_24_P883109 | AL833452 | GGGCAACTAGTCATCTACTAGTTAGCTTAGTAAGGTAAGGATTAAATCTAAGAAATAGCA | SEQ ID NO: 431 | Homo sapiens mRNA; cDNA DKFZp686E08116 (from clone DKFZp686E08116). [AL833452] |
| 432 | A_24_P898583 | TRIM26 | TTGACCACCATTGTCTCAGAGCGCTGCCCACTTTGTGTGTGTGCACATGCTGCCTGAGTGACA | SEQ ID NO: 432 | Homo sapiens tripartite motif-containing 26 (TRIM26), mRNA [NM_003449] |
| 433 | A_24_P910490 | BX099367 | AGGGACCCAGAGTTGCAGACCACCTTGGGCTACAGAGGTGACAGGCTGTGTGATAGAAAACTA | SEQ ID NO: 433 | BX099367 Soares_fetal_liver_spleen_1NFLS_S1 Homo sapiens cDNA clone IMAGp998C05977, mRNA sequence [BX099367] |
| 434 | A_24_P914102 | A_24_P914102 | TTAGTAGACCCTAGATTTTGTGTACAAATGTAAAATGTTATTTTTACTGTTGAAAATCAG | SEQ ID NO: 434 | |

Fig. 1-25

| No. | Probe ID No. | Symbols of genes | Sequence | SEQ ID NO: | Descriptions of genes (letters and numbers within [ ] indicates GenBank accession No.) |
|---|---|---|---|---|---|
| 435 | A_24_P916006 | AA435826 | GGAAATGGTCTTCGGGTGGACGGATCAAGGAAAGCAGTCCCTGAC CTTGCAGAAAGTGGT | SEQ ID NO: 435 | AA435826 zt80a02.s1 Soares_testis_NHT Homo sapiens cDNA clone IMAGE:728618 3' similar to TR:G790819 G790819 POLYCYSTIC KIDNEY DISEASE-ASSOCIATED PROTEIN. ;, mRNA sequence [AA435826] |
| 436 | A_24_P921402 | THC2484646 | AGTGTTGGGCATCCACTTCAGTAGAATTCAGCTGACAATATGAT GAATCATTCCAGAGA | SEQ ID NO: 436 | |
| 437 | A_24_P923684 | SIRT3 | GGAATTGGTGACCTAGGAAAACTGTTGAATTCTAAAAAGAATGAA GTTAGTTCTAACCC | SEQ ID NO: 437 | Homo sapiens sirtuin (silent mating type information regulation 2 homolog) 3 (S. cerevisiae) (SIRT3), transcript variant 1, mRNA [NM_012239] |
| 438 | A_24_P924462 | PRKCZ | GCATAGAGATGAAAGATGATATTTTAATTCTATCATTGAGGCATAG TCTTCCAAGACACC | SEQ ID NO: 438 | Homo sapiens mRNA, chromosome 1 specific transcript KIAA0505. [AB007974] |
| 439 | A_24_P92852 | ARID1A | ATCACCGTTGATGAACTCATTGGTTCACAAGTCATTTGTGATGT ACTGTTTTGATTGG | SEQ ID NO: 439 | Homo sapiens AT rich interactive domain 1A (SWI-like) (ARID1A), transcript variant 1, mRNA [NM_006015] |
| 440 | A_24_P93062 | CXXC5 | GCGCTTTCCCATGAACCCAAGGCTGTTCATTATGACCCCGGCAG GTGTGTTCCTGGCCG | SEQ ID NO: 440 | Homo sapiens CXXC finger 5 (CXXC5), mRNA [NM_016463] |
| 441 | A_24_P930337 | THC2503773 | AGCAAGTGGAACCGACGACCAAAATATGACTTGAAGAATGTAATT TAAAATGTAGCATAG | SEQ ID NO: 441 | |
| 442 | A_24_P930391 | AK022351 | AAGTGGGTTTAATTTCGTTTCATGAAAAGGAAAGATTAGGTTTCA TGGAAACAGTTGGTC | SEQ ID NO: 442 | Homo sapiens cDNA FLJ12289 fis, clone MAMMA1001788. [AK022351] |
| 443 | A_24_P930707 | THC2653001 | ATGTTAGTTACGTCGGCTTGCCATGTGTCAGTGTGGACACAGGCTGGTTTCC ACAGTTTAAAAGAA | SEQ ID NO: 443 | BX098637 BX098637 Soares fetal liver spleen 1NFLS Homo sapiens cDNA clone IMAGp998F16386 ; IMAGE:200847, mRNA sequence [BX098637] |
| 444 | A_24_P92418 | AP2A2 | CGGCGCTGCAGAGAGGGGCCTCAGTGTGCAGTCCTGCGTCAAAGAA AATAAAGGGTAGAA | SEQ ID NO: 444 | Homo sapiens adaptor-related protein complex 2, alpha 2 subunit (AP2A2), mRNA [NM_012305] |
| 445 | A_24_P933514 | AK094334 | CGTAGTCCCACTGTAGAATTTCCTTAGGTGGCCATATATATAC TACGTGAACTGTGGC | SEQ ID NO: 445 | Homo sapiens cDNA FLJ37015 fis, clone BRACE2010208. [AK094334] |
| 446 | A_24_P934861 | A_24_P934861 | GGAGGTATCAAGCAGGAAAGTTCTGGGAAATAGTGGACC AGATCGTCTCGATGG | SEQ ID NO: 446 | |
| 447 | A_24_P935682 | AY358248 | AGTCAGTAATCAGCATTCAATCAATATGAGGTCTAACATGATGCT TGACAGTATGCAAC | SEQ ID NO: 447 | Homo sapiens clone DNA166629 MRSS6228 (UNQ6228) mRNA, complete cds. [AY358248] |
| 448 | A_24_P93703 | LOC440104 | GGGATGGCACTAATTTCGTCGTTAACCAGAAGTTGTTCCAGCGAC TGAGCGCATTCTAAGT | SEQ ID NO: 448 | Homo sapiens cDNA FLJ36942 fis, clone BRACE2005518. [AK094261] |
| 449 | A_24_P940310 | ENST00000270201 | AGGTTGACCTCCCATCCAGCGGCTGTATGTGAGTGTAGTTCATTTT ATATCGATAGCGAA | SEQ ID NO: 449 | Nucleolar preribosomal-associated protein 1 (Fragment). [Source:Uniprot/SWISSPROT:Acc:O60287] [ENST00000270201] |
| 450 | A_24_P940551 | FLJ38723 | TTGGCAGGTTACCCGCTTTACCCTTTACAGTAGGAAAATAAGACCCCT ATCTAGTGAGGGAGA | SEQ ID NO: 450 | Homo sapiens hypothetical protein FLJ38723 (FLJ38723), mRNA [NM_173805] |
| 451 | A_24_P942604 | SMC1A | GGGGGTGACAAGATAAGGCCAGGCTCTAGAGCGTGCTTTGGATCATGA ACCATTTCAAGTTT | SEQ ID NO: 451 | Homo sapiens structural maintenance of chromosomes 1A (SMC1A), mRNA [NM_006306] |

Fig. 1-26

| No. | Probe ID No. | Symbols of genes | Sequence | SEQ ID NO: | Descriptions of genes (letters and numbers within [ ] indicates GenBank accession No.) |
|---|---|---|---|---|---|
| 452 | A_24_P942893 | TEX261 | GATGCAGTGGCTCTCCATTGCCACTCTGATTCCTGCGTTCTTTTG GTCACAGAGAAAGGG | SEQ ID NO: 452 | Homo sapiens testis expressed 261 (TEX261), mRNA [NM_144582] |
| 453 | A_24_P945262 | AK097139 | ACAGTCTGTGTATACGGTGGTCAGAGTGTGGCTGAGACACATG AGATGGTAAAGAATT | SEQ ID NO: 453 | Homo sapiens cDNA FLJ39820 fis, clone SPLEN2010625. [AK097139] |
| 454 | A_24_P96234 | QTRT1 | TGCCGAAGGACAAGGCCCGATATGTGATGGCGGGTTGGCTATGCCA CTGATCTGTAGTCT | SEQ ID NO: 454 | Homo sapiens queuine tRNA-ribosyltransferase 1 (tRNA-guanine transglyosylase) (QTRT1), mRNA [NM_031209] |
| 455 | A_24_P96325 | ZGPAT | CCAGCTCTCGGAATGTGTTTGACTTCCTCAATGAAAAGCTGCAA GGTCAGGGTCGTGGG | SEQ ID NO: 455 | Homo sapiens zinc finger, CCCH-type with G patch domain (ZGPAT), transcript variant 1, mRNA [NM_032527] |
| 456 | A_32_P10633 | BC022417 | GTTGATGTTTAAACAGGAAGCTCCACGGAGTTCAGCCCTGTGTG CATTCCTCATGTAT | SEQ ID NO: 456 | Homo sapiens cDNA clone IMAGE:4243782, partial cds. [BC022417] |
| 457 | A_32_P111394 | THC2643957 | GAATACAGTGTTGCTTTTTCATCCCATATTTGAGTGAACCTAAGAC ACATCAATTATAAGG | SEQ ID NO: 457 | |
| 458 | A_32_P112546 | LOC649344 | AGGGAGGTCAGTATGACAGGTAGGACTGGGAACAGGAGCAGCCACC TGAGGCTCAGCCCTA | SEQ ID NO: 458 | PREDICTED: Homo sapiens similar to Keratin, type II cytoskeletal 8 (Cytokeratin-8) (CK-8) (Keratin-8) (K8) (LOC649344), mRNA [XR_018597] |
| 459 | A_32_P116997 | THC2719256 | AAACATTAGGTAGGCAGCTTGTGAGAGGATAGTATTTAGGGTCATGAT GTCCTTCTTGTTGGC | SEQ ID NO: 459 | BE147120 PM2-HT0224-221099-001-b10 HT0224 Homo sapiens cDNA, mRNA sequence [BE147120] |
| 460 | A_32_P118220 | AK091308 | GAATGTAACACACTTCGTCGGGGTTTGGGAGGTGGATATAATATCAT TATGGCGTTCTCAG | SEQ ID NO: 460 | Homo sapiens cDNA FLJ33989 fis, clone DFNES2006944. [AK091308] |
| 461 | A_32_P11899 | C12orf65 | AAGGAGTACCGTGCAGTGCTGCTTCCTTGGATGGAGAATGAAGTCGAA GAGCAGTTGTGAAA | SEQ ID NO: 461 | Homo sapiens chromosome 12 open reading frame 65 (C12orf65), mRNA [NM_152269] |
| 462 | A_32_P120454 | THC2642550 | ACAGAATCAGATGACTGGAGTGGTTCATCTGTTGTTTATTGGCAAGCT CAGGACAGGGTATGA | SEQ ID NO: 462 | |
| 463 | A_32_P121755 | THC2672892 | AAACCCTCGTGCTCCAGAGTGGTTCCGGGCGTGGCATTTGTTGAGGTGG GATTCCGAGGCCAGA | SEQ ID NO: 463 | Q2TXF9_ASPOR (Q2TXF9) Predicted protein, partial (5%) [THC2672892] |
| 464 | A_32_P124493 | LOC642826 | AAGAAAAGAGGGTTACAGATCATTGGCACATGGAGAAATATTCCC ABCAGTAACGACTTC | SEQ ID NO: 464 | Homo sapiens cDNA FLJ39589 fis, clone SKMUS2008607. [AK096908] |
| 465 | A_32_P124538 | THC2758091 | AGTAGGGTTGGTCTTCTTGATTCCGGGAGAGCCTCATGTAAGCAG GTCGTTAAACCAGAC | SEQ ID NO: 465 | |
| 466 | A_32_P125589 | THC2649341 | CGGCTCTATCGCTTGCTTTGCTTTTGAATGAAAGTGAGATGTCT CATCAGCTCAGATAG | SEQ ID NO: 466 | |
| 467 | A_32_P12703 | THC2697162 | TTGAAGGAAAAGAGTATAGGGGGGAAGTGCCAGACTAAACGAATC CTAAGTAAATAGGGT | SEQ ID NO: 467 | |
| 468 | A_32_P127583 | THC2650423 | AGAGAGGCCCTTCTATGTACATGAGTGTTCTGTCCCTTAGGTAGAT TAGTTCATCCAACTG | SEQ ID NO: 468 | |
| 469 | A_32_P131294 | BM854107 | AGTAGGGAAAAAGGTTTGTTGTTCGTTAATAAGGGTAGTGTCGGGAAA TGCTAGCACTTGTGC | SEQ ID NO: 469 | K-EST0136406 S22SNU16nT Homo sapiens cDNA clone S22SNU16n1-145-F11 5', mRNA sequence [BM854107] |
| 470 | A_32_P136538 | BF928446 | CTGCCGAAATGGTGAGAAATAAAAGGAAGCATTCTGGCGTTCTCAG GTTTTTCAAACTCAC | SEQ ID NO: 470 | BF928446 IL2-NT0200-061200-260-F07 NT0200 Homo sapiens cDNA, mRNA sequence [BF928446] |

Fig. 1-27

| No. | Probe ID No. | Symbols of genes | Sequence | SEQ ID NO: | Descriptions of genes (taken and numbers within [ ] indicates GenBank accession No.) |
|---|---|---|---|---|---|
| 471 | A_32_P138178 | BE835321 | AGATTGGCCTTAATCCCAGAGACAGTATGAGATACAATTCTGGGACTTTGTCTTCGTAACC | SEQ ID NO: 471 | BE835321 RC5-FN0022-300600-022-G12 FN0022 Homo sapiens cDNA, mRNA sequence [BE835321] |
| 472 | A_32_P145385 | AK001118 | CGGCAATTAACACTCGAGGAAGCTTAAATTTCAAGCTTTTTGATTCTCAGGAAATGAGAT | SEQ ID NO: 472 | Homo sapiens cDNA FLJ10256 fis, clone HEMBB1000870. [AK001118] |
| 473 | A_32_P146844 | THC2539689 |  GCTGTGGGCTGTATTCCAGACTGAGAGTTGAAGTTTGTGTGCATCATCATGTGCATTAA | SEQ ID NO: 473 | |
| 474 | A_32_P151244 | AK022268 | GTAGTCAGATGTGAGAGAGTTATTTCATGTGTAAGCTTTGAAGTGTTGATGTGTT | SEQ ID NO: 474 | Homo sapiens cDNA FLJ12206 fis, clone MAMMA1000941. [AK022268] |
| 475 | A_32_P151544 | KRT18 | GAGGACTTCATCCTTGGTGATGCCTTGGACAGCAGCAAGCTCCATGCAAAACCATCGAAAAG | SEQ ID NO: 475 | Homo sapiens keratin 18 (KRT18), transcript variant 1, mRNA [NM_000224] |
| 476 | A_32_P155091 | ATXN2L | GAGTGACCTGTGTGAGACAGATGCCCATGAGGATGGCTGGACAAGAAGCTTTTA | SEQ ID NO: 476 | Homo sapiens ataxin 2-like (ATXN2L), transcript variant B, mRNA [NM_145714] |
| 477 | A_32_P155416 | PRNPIP | TAGATCCAAACGTCAAGTCAATTTTGTCACGTGCTGGGAGACTGGGAGTGTTGATGTGC | SEQ ID NO: 477 | Homo sapiens prion protein interacting protein (PRNPIP), mRNA [NM_024066] |
| 478 | A_32_P155841 | AL079294 | CCTTCCTGTTTATATACCTGCAGTTACCAGTTGTTGTTGTTAAGGAAGAATGGCAAATGCAAA | SEQ ID NO: 478 | Homo sapiens mRNA full length insert cDNA clone EUROIMAGE 362780. [AL079294] |
| 479 | A_32_P158171 | THC2634329 | TCCTATGTGGACTCTGATTTAAGGGGTATAAGGCTGTCTGTCTTCCGTACCGAATAGAAGGTT | SEQ ID NO: 479 | |
| 480 | A_32_P159176 | THC2744561 | CAGAAGAAGATAGAAGCAGCATCTCACCAAAGACAAGCAAGTTGACCCTAAGTCTTAAATCAT | SEQ ID NO: 480 | |
| 481 | A_32_P162095 | THC2673084 | AAGGTGCTTTATTTGTGGGCCAAATAGTAGGAGGTATTAGATACGTTGGTGGGCCAAGAA | SEQ ID NO: 481 | |
| 482 | A_32_P163458 | tcag7.1017 | AGATGTGGATTTTCAGGAGGACGTTATTCCAATGCTAATGGCAGACATCAGGAAGGAGG | SEQ ID NO: 482 | Homo sapiens similar to Williams Beuren syndrome chromosome region 19 (MGC57359), mRNA [NM_001004351] |
| 483 | A_32_P164573 | THC2611661 | AGGTGTTTCTATTAACACTCGAAGTACTCTGAGAGCTTGGAAATTTCAAGTGCAAAATC | SEQ ID NO: 483 | RR12_SPINX (P42344) Chloroplast 30S ribosomal protein S12, partial (11%) [THC2611661] |
| 484 | A_32_P16462 | THC2567672 | GGCAGAAGAATGGGAGGACAGTGATGAGGAATAATTTTCAGTCTTTATCATTTTATAT | SEQ ID NO: 484 | W18193 IMAGE:20064 Soares infant brain 1NIB Homo sapiens cDNA clone IMAGE:20064, mRNA sequence [W18193] |
| 485 | A_32_P165990 | AK094623 | TGTGGGGACACAGACAGACTCGTCGCATGGGTGATTTAATTTTGGGCCTCAGTT | SEQ ID NO: 485 | Homo sapiens cDNA FLJ37304 fis, clone BRAMY2016070. [AK094623] |
| 486 | A_32_P165356 | THC2685727 | GTGTCTGATTTTAGCCACCAGTGAAAAACAAGGGTGAATTGCTTAATGCCTGCAATGCTG | SEQ ID NO: 486 | |
| 487 | A_32_P167883 | THC2697442 | AGGTAATTGGGGGTATGACTTCAGTCAGTTTGAAATATTGGGAACTAAATCTCTCATT | SEQ ID NO: 487 | |
| 488 | A_32_P169316 | A_32_P169316 | AGGAAGTGGAAGCATACTACTTGTTAGCCACGAGCTAGATGGCAAAGCAGCTGTTTGAATATAAC | SEQ ID NO: 488 | |
| 489 | A_32_P170811 | KIAA1509 | CAGTGTGAGGAGAAAGAGCAGTTCATTGAAAGAATCAAACAGCTGGACATTGAGACCCAG | SEQ ID NO: 489 | Homo sapiens KIAA1509 (KIAA1509), mRNA [NM_001080414] |
| 490 | A_32_P176609 | ZNF609 | ATGATGGCTCTGATGATGGACCCTCAGTCATGATGGATGAAAACAAGGCAATGATGCCTTTGATT | SEQ ID NO: 490 | Homo sapiens zinc finger protein 609 (ZNF609), mRNA [NM_015042] |

Fig. 1-28

| No. | Probe ID No. | Symbols of genes | Sequence | SEQ ID NO: | Descriptions of genes (letters and numbers within [ ] indicates GenBank accession No.) |
|---|---|---|---|---|---|
| 491 | A_32_P179526 | ZBTB20 | TTGAAGTTGGAAATCAAGGGGAATCTAAAACCGACGATGTTTCTGCTGCTGGGAAAGG | SEQ ID NO: 491 | Homo sapiens zinc finger and BTB domain containing 20, mRNA (cDNA clone IMAGE:4291354), partial cds. [BC010934] |
| 492 | A_32_P181564 | THC2606490 | TTATAAGTGCCGTTAATATCTCCAGTATCTCCACAGAGAATTTTGTCTTCAAGGCTTGGC | SEQ ID NO: 492 | |
| 493 | A_32_P184039 | A_32_P184039 | ATCATTGTTAGTCTTGGGCCAAAATAGTTGTTATGTATCATGCGTAATAACTGACGAGC | SEQ ID NO: 493 | |
| 494 | A_32_P185361 | AL109784 | GGAAGGCTGTTTGCTGAATAAGACAAAGATACAGAGCATGCAAAGTAAAGGATGTGGGCGT | SEQ ID NO: 494 | Homo sapiens mRNA full length insert cDNA clone EUROIMAGE 122871. [AL109784] |
| 495 | A_32_P187304 | A_32_P187304 | ATAAATGAGAAGAACATTCACATAGAACAAAGGTGTGGTGGAAGGCTCTGACCAGCTTAACC | SEQ ID NO: 495 | |
| 496 | A_32_P192545 | TCEAL6 | ATTTGGGAGGCCGAATGCTTAACCTTAAGCTAGGCTGATATTTTGGTTTAGATGTCAATCTGG | SEQ ID NO: 496 | Homo sapiens transcription elongation factor A (SII)-like 6 (TCEAL6), mRNA [NM_001006938] |
| 497 | A_32_P194072 | DKFZP434B0335 | ATGGGGCTCAGGGCCTCTTTACCATGTGCAGTGACGATGCAGTGAACATTCTCAGAGCAGGACTTGCAAA | SEQ ID NO: 497 | Homo sapiens DKFZp434B0335 protein (DKFZP434B0335), mRNA [NM_015395] |
| 498 | A_32_P196297 | THC2652466 | CCTTTCAGAAAGACTGTAAGGCTTACGCAAGAGCATTAATTTTGCTGCATAGGCGGCCTGTT | SEQ ID NO: 498 | Q9BHM3_PARIE (Q9BHM3) Cytophilin-RNA interacting protein, partial (4%) [THC2652466] |
| 499 | A_32_P198845 | THC2651047 | GCGAACCAATCAACAACTGTCTTCAGTGAGTGACAGTGCTTCTATAGCTAACAATTAACC | SEQ ID NO: 499 | |
| 500 | A_32_P19917 | BM684461 | ATATGATCTTAAGAGTGTAAACATTCAAGAGACGAGGGCAAGAAAGCGAGTCACATGTAG | SEQ ID NO: 500 | Ui-E-EJO-aip-c-14-0-UI.si Ui-E-EJO Homo sapiens cDNA clone Ui-E-EJO-aip-c-14-0-UI 3', mRNA sequence [BM684461] |
| 501 | A_32_P200429 | A_32_P200429 | GGAGGAGAGTTCACATCTGGACCATTGAGAACAGGAAGCGACTCATTAAAGATGTTA | SEQ ID NO: 501 | |
| 502 | A_32_P203515 | SPECC1L | GATTCCTTTTGCCTCGTCTGATAATGGATGCTTAGGACACTGTGGGCTTTAGGAATGACTA | SEQ ID NO: 502 | Homo sapiens SPECC1-like (SPECC1L), mRNA [NM_015330] |
| 503 | A_32_P204565 | A_32_P204565 | CAGGATCAGAATGATACACCGGGATGTGTTTCAGTGTGATGGAAAGATTGTTTCCAGTGA | SEQ ID NO: 503 | |
| 504 | A_32_P205323 | tcag7.1017 | TCATCTAGAAGAACCTGGACCATTCTTGGACAGAGCTGAATACAGTGATCACGTTGTCCTC | SEQ ID NO: 504 | Homo sapiens similar to Williams Beuren syndrome chromosome region 19 (MGC57359), mRNA [NM_001004351] |
| 505 | A_32_P208039 | AL049390 | TTTCATGTTGAGCATTCAGATTGGGCTTTATTTCTCAAGGCATGTGGCAAAGCTCACAA | SEQ ID NO: 505 | Homo sapiens mRNA; cDNA DKFZp586O1318 (from clone DKFZp586O1318) [AL049390] |
| 506 | A_32_P209562 | THC2663167 | CAATGTAAAGCCAGAATATGAACGTCGTTTTGTCAAGATTTTCAAACGTATTTGGCTGAT | SEQ ID NO: 506 | ALU1_HUMAN (P39188) Alu subfamily J sequence contamination warning entry, partial (5%) [THC2663167] |
| 507 | A_32_P211048 | A_32_P211048 | GTTCACAAAAACACCTAGTAGGTATTCAGTTCATATTGGGAATGAATGAGAAAATGAGCAG | SEQ ID NO: 507 | |
| 508 | A_32_P213509 | THC2663555 | GATTTGTTCCAGTGTTGGAGCGCGTTTTTAATGAAAAATCTCAACACCTACACTCGGAAAA | SEQ ID NO: 508 | |
| 509 | A_32_P214054 | THC2755661 | GGCTTATCTCCTTTGTTTAACAGTTGGGGGTTGGCTTCGCATAGCAATGATTTGCAAAT | SEQ ID NO: 509 | |

Fig. 1-29

| No. | Probe ID No. | Symbols of genes | Sequence | SEQ ID NO: | Descriptions of genes (letters and numbers within [ ] indicates GenBank accession No.) |
|---|---|---|---|---|---|
| 510 | A_32_P216122 | AK130891 | TTCTTCCTCTATATGTTTGGGAGGGCATTCATGAAGAATTGAGTAG AGATATATGGGTC | SEQ ID NO: 510 | Homo sapiens cDNA FLJ27381 fis, clone UBA07680. [AK130891] |
| 511 | A_32_P220567 | A_32_P220567 | GGAAAGTGAAAAATAGTTCCTATGGTGGAAGGTGGGGGTGAGAC ATACCTCCTCTGAAA | SEQ ID NO: 511 | |
| 512 | A_32_P220580 | AK124352 | ACCGAGGAGAATCAGGACTACTATCTTTTGGGAAATAAGCTGGGTCC TTATGATGGAGTCGG | SEQ ID NO: 512 | Homo sapiens cDNA FLJ42361 fis, clone UTERU2025366. [AK124352] |
| 513 | A_32_P224522 | SLC25A23 | CTTACATTCTGCACTCATAGTTGGATTCTGAGGTAGGATCATG TGGAGACCCGATGGA | SEQ ID NO: 513 | Homo sapiens solute carrier family 25 (mitochondrial carrier; phosphate carrier), member 23 (SLC25A23), mRNA [NM_024103] |
| 514 | A_32_P225625 | AA971667 | GCCAAATGCTGCTCCTTTTCCAAGAGATAGAAAAGCATCTTTTAA ATCATCCTCCATTTT | SEQ ID NO: 514 | AA971667 opB5c06.s1 Soares_NFL_T_GBC_S1 Homo sapiens cDNA clone IMAGE:1583626 3', mRNA sequence [AA971667] |
| 515 | A_32_P227110 | THC2512148 | TAAACAAATCCTTTTGATTCAGGCGACTGTGTATTGATAATGGCT TATTTATTACAATCA | SEQ ID NO: 515 | |
| 516 | A_32_P227657 | BX114900 | GTCGAGACCTGAACAGAAGCTTCCTGAGACTTAGTCAGGGCCGTG TTTCACGGTAAGGAC | SEQ ID NO: 516 | BX114900 Soares_fetal_liver_spleen_1NFLS_S1 Homo sapiens cDNA clone IMAGp998L191010, mRNA sequence [BX114900] |
| 517 | A_32_P232651 | THC2645586 | CTTTGAAAAGGATATCCTTCAACATTCGTTTTCGAGAAAATGAGG TCACGTGACTTATTTC | SEQ ID NO: 517 | Q9P3E1_NEUCR (Q9P3E1) Related to rna-binding protein fus/tls, partial (5%) [THC2645586] |
| 518 | A_32_P234661 | THC2650029 | AACCAAGATAAGCTAAGTAAGTCAGGCTTTGATTTGTCGTTGCCA GGAAAAAGACTTAGG | SEQ ID NO: 518 | Q88PH0_PSEPK (Q88PH0) Dipeptide ABC transporter, permease protein, partial (5%) [THC2650029] |
| 519 | A_32_P29442 | AI911989 | ATAGTTTACATGTGCGACATGAGCTAGTGTTGTTGTACATGTGACAG ACCTTGTTTCTGGAT | SEQ ID NO: 519 | AI911989 wd78e07.x1 NCI_CGAP_Lu24 Homo sapiens cDNA clone IMAGE:2337732 3', mRNA sequence [AI911989] |
| 520 | A_32_P3342 | THC2676548 | TATAGCATTTTGTGAAAGATACATGTTGTAGCTCGTTCTCGTTCGTCTAGA TGATTTGGTCAACAG | SEQ ID NO: 520 | ALU7_HUMAN (P39194) Alu subfamily SQ sequence contamination warning entry, partial (19%) [THC2676548] |
| 521 | A_32_P38782 | BX113029 | CATGCTGAGTGTGAGAAGTGCAGTGCCGTTTCTCTACCCACAGCC ACTCAGACGACCCAG | SEQ ID NO: 521 | BX113029 Soares_fetal_liver_spleen_1NFLS_S1 Homo sapiens cDNA clone IMAGp998E061010, mRNA sequence [BX113029] |
| 522 | A_32_P402521 | PRPF8 | GTGCTCGTCAGTGGAACTACAACTTCATGGGTGTTCGGCATGACCGCAA CATGAAATATGAGCT | SEQ ID NO: 522 | Homo sapiens PRP8 pre-mRNA processing factor 8 homolog (S. cerevisiae) (PRPF8), mRNA [NM_006445] |
| 523 | A_32_P40673 | A_32_P40673 | CATCACACTTGATATATAGGACAGCCTACCTACTTGTTTGAGTGTC ACAGCGTGATATGTA | SEQ ID NO: 523 | |
| 524 | A_32_P430359 | DDX54 | CCTGAGTGCCTCAGGGTTTGGGAATGGAATTTTTAATGTAATAAA TCTTTATTGAGCACT | SEQ ID NO: 524 | Homo sapiens DEAD (Asp-Glu-Ala-Asp) box polypeptide 54 (DDX54), mRNA [NM_024072] |
| 525 | A_32_P43878 | DB111455 | ATGTGAGAAAGGTTCTTTAAGGTTTAATGACGAAGTTCCATGTG AGGTCTTAGTTGGGA | SEQ ID NO: 525 | DB111455 THYMU2 Homo sapiens cDNA clone THYMU2015028 5', mRNA sequence [DB111455] |
| 526 | A_32_P46404 | AK092468 | CTGCATGCCGAACGTCTTTTGCATAAATACTTATGGATTCAGCC AAGAGGAAAAGCACT | SEQ ID NO: 526 | Homo sapiens cDNA FLJ35149 fis, clone PLACE6010485. [AK092468] |
| 527 | A_32_P514790 | UNK | AGGACGAAAAGGGCGTTCAATGAATTAAGTGAAAACTTTTTGTTT TTTACAAAATGCAA | SEQ ID NO: 527 | Homo sapiens unkempt homolog (Drosophila) (UNK), mRNA [NM_001080419] |

Fig. 1-30

| No. | Probe ID No. | Symbols of genes | Sequence | SEQ ID NO: | Descriptions of genes (letters and numbers within [ ] indicates GenBank accession No.) |
|---|---|---|---|---|---|
| 528 | A_32_P52206 | TYW1 | GAGGAAGCATCCATTGATTTCGATTTGGCAAAACTTACGTGAAG GGTATGAGAGATGGG | SEQ ID NO: 528 | Homo sapiens tRNA-yW synthesizing protein 1 homolog (S. cerevisiae) (TYW1), mRNA [NM_018264] |
| 529 | A_32_P55161 | CENTG2 | AAAGAGGGTTACAGATGATTGCACAGATGCAAAATATTCCCAGCAGT AAACACTTCCATTA | SEQ ID NO: 529 | Homo sapiens centaurin, gamma 2 (CENTG2), transcript variant 1, mRNA [NM_001037131] |
| 530 | A_32_P5542 | AF131782 | GAGGCTGTTACGATGTAACTTCGACTGAGTAACGTGGGAAGAAATGTCTT ATAAATAAACAACAG | SEQ ID NO: 530 | Homo sapiens clone 24941 mRNA sequence. [AF131782] |
| 531 | A_32_P55427 | THC2701763 | CAGTTTTATCCCTTATCTGTAAAAGAAACTACAAATTGAGAGAGTA CATTCGATAGGCTGG | SEQ ID NO: 531 | Q9F6M7_CARHY (Q9F6M7) DTDP-glucose 4,6-dehydratase (Fragment), partial (11%) [THC2701763] |
| 532 | A_32_P55987 | THC2639487 | GAAAAGAAGCCCAGTCGTGTAACGGAAGTCTAATAGCTGCTCAGTA CATAGTAAATGCTAT | SEQ ID NO: 532 | Q70GE4_ANOGA (Q70GE4) ENSANGP00000015281 (Fragment), partial (6%) [THC2639487] |
| 533 | A_32_P6740 | JMJD1C | GAGTGGGTTAAAGTTTATGAAGATTTTCAACTTTCGTTGGTGGAA TACCACTTAATGTGG | SEQ ID NO: 533 | Homo sapiens jumonji domain containing 1C (JMJD1C), transcript variant 1, mRNA [NM_032776] |
| 534 | A_32_P6415 | TNRC6B | GCATAAGGTTTAATCAAACTCCCATATGTTGAAATTGGTCTCTGA TATTACTGGTTTTAC | SEQ ID NO: 534 | Homo sapiens trinucleotide repeat containing 6B (TNRC6B), transcript variant 1, mRNA [NM_015088] |
| 535 | A_32_P65067 | THC2618074 | CCCCAAAGTGAATTTAAACTTGACTTATTTATGCCGTTCTCAT AGCAACAGGAAAAGT | SEQ ID NO: 535 | |
| 536 | A_32_P6972 | THC2621771 | AGGGCTGATTGTGGAAATGATGGTTAGAGTCAGAGAAGAAAGTGAGAG TGATGAAGGCAGAAT | SEQ ID NO: 536 | |
| 537 | A_32_P70875 | CD239706 | CTTTGTTTGAGAAGTTCCTAATGCAGTAGGAGAGGAAGAAGTGACAG TTTTGTTTATTTACTG | SEQ ID NO: 537 | FNPXFO3 FNP Homo sapiens cDNA, mRNA sequence [CD239706] |
| 538 | A_32_P71171 | A_32_P71171 | TCTAGATAGTAATAGGAAACCAAGAATCCAGGTGGTGATGGGTG GAGGGAGTGATTGAA | SEQ ID NO: 538 | |
| 539 | A_32_P718498 | MLLT6 | CCACAGCTATTCCCGAGCTATAGAGTGGGCAATTCTCACCTTCA AAGAGTCCCGCACCTG | SEQ ID NO: 539 | Homo sapiens myeloid/lymphoid or mixed-lineage leukemia (trithorax homolog, Drosophila); translocated to, 6 (MLLT6), mRNA [NM_005937] |
| 540 | A_32_P749354 | MGC11102 | GTTTTGTGTTTTCGGCTGTCGTCCTGTCTATTGGATGTGATATGTTAT GGATGTGATGTGTTA | SEQ ID NO: 540 | Homo sapiens hypothetical protein MGC11102 (MGC11102), mRNA [NM_032325] |
| 541 | A_32_P79103 | BM932034 | GTGCTACAGAATGAAAATAGACATTTTAGGAAGGTTGAGTCAGAGG TGGAGTGGGGCATA | SEQ ID NO: 541 | UI-E-EJ1-aji-k-24-0-UI.r1 UI-E-EJ1 Homo sapiens cDNA clone UI-E-EJ1-aji-k-24-0-UI 5', mRNA sequence [BM932034] |
| 542 | A_32_P81357 | FAHD2A | CAACACCAAGCAAGCAGATGGTATTCAAGACAGAGGAGCTGATAGCCTG GGTGTCCCAGTTTGT | SEQ ID NO: 542 | Homo sapiens fumarylacetoacetate hydrolase domain containing 2A (FAHD2A), mRNA [NM_016044] |
| 543 | A_32_P8251 | KIAA1542 | TCGAGTTCGTCGTCGCTGACACGTCGTCGTGCACGTGTGTTGCTCA CAGTTGAAAACTGGA | SEQ ID NO: 543 | Homo sapiens CTD-binding SR-like protein rA9 (KIAA1542), mRNA [NM_020901] |
| 544 | A_32_P83453 | LOC647768 | TTTTCTTGGATGTCCCCGTTTTGTTGTTGATTGACAACTGTAT TGCATTGAAGAAAGT | SEQ ID NO: 544 | PREDICTED: Homo sapiens similar to tetratricopeptide repeat protein 3 (TPR repeat protein 3) (TPR repeat protein D) (LOC647768), mRNA [XR_018202] |
| 545 | A_32_P84289 | C1orf93 | ACAGTGGAACGTGTCTGCGAAGGAGCGGCCAGGTTCTGCAGCGACCC CAGTAGCCTGTGGGT | SEQ ID NO: 545 | Homo sapiens chromosome 1 open reading frame 93 (C1orf93), mRNA [NM_152371] |
| 546 | A_32_P86 | LOC728411 | TCGTCGAGGAGGTCTGGGATGTCTGGTTATATCGTGATTTCTGACC TCTGGGCATGGAGGT | SEQ ID NO: 546 | Homo sapiens, clone IMAGE:4590099, mRNA. [BC048193] |

Fig. 1-31

| No. | Probe ID No. | Symbols of genes | Sequence | SEQ ID NO: | Descriptions of genes (letters and numbers within [ ] indicates GenBank accession No.) |
|---|---|---|---|---|---|
| 547 | A_32_P88626 | PHACTR4 | TGAAGGCTGAGAGGAAGGCTCAGGATGTGACATGTCTTCCTTTTCGTCACAAGTCATCAT | SEQ ID NO: 547 | Homo sapiens phosphatase and actin regulator 4 (PHACTR4), transcript variant 2, mRNA [NM_023923] |
| 548 | A_32_P88987 | AK022346 | ATGGGAAGTTAGTACGCAGGCTTACCAAAAGGTCAGGTTTATATAAAGTGGCGTTCCTTT | SEQ ID NO: 548 | Homo sapiens cDNA FLJ12284 fis, clone MAMMA1001757. [AK022346] |
| 549 | A_32_P90468 | A_32_P90468 | AAGGCAGGAATAATTTTCTATCTCATGGTAAGCTAACTGCTGGAAGTTATGATGAGACCCT | SEQ ID NO: 549 | |
| 550 | A_32_P91328 | THC2641595 | GTTAGGCGAATAATGTCATTGAAGTCTTAAGCTCTAGGCTGACTCTAACGGCAGGGTTCA | SEQ ID NO: 550 | |
| 551 | A_32_P92783 | STIP1 | CCAGGCACTCAGGGAACAGTTAAAGAATCCGTAATCGCAAAGAAGATCCAGAAGCTGAT | SEQ ID NO: 551 | Homo sapiens stress-induced-phosphoprotein 1 (Hsp70/Hsp90-organizing protein) (STIP1), mRNA [NM_006819] |
| 552 | A_32_P97305 | THC2681839 | AATATGGACACACAAAACTAAAGAAAGGATGTCAGTTGAGCACACAGGTTCGTGCCGCCT | SEQ ID NO: 552 | |
| 553 | A_32_P98847 | POLRMT | AGGCAGAAGAACGGCTTGCCGCCCAACTTCATGCAGTCGCTGGACTCCTCACACATGATGC | SEQ ID NO: 553 | Homo sapiens polymerase (RNA) mitochondrial (DNA directed) (POLRMT), nuclear gene encoding mitochondrial protein, mRNA [NM_005035] |
| 554 | A_32_P98940 | THC2745859 | AAGGTATTCCCAAGATAGCAAAGGTGTGTTGTTTTAGGCAGGTGTATTTCAGCTAGTTA | SEQ ID NO: 554 | |
| 555 | A_32_P99097 | TNPO1 | AAATTGGAGGCATTTCTCTGACCAGTTTGCGTCTCCCTTAAAAAGAGCGTCTTGCAGGTG | SEQ ID NO: 555 | Homo sapiens transportin 1 (TNPO1), transcript variant 1, mRNA [NM_002270] |
| 556 | A_23_P102235 | SNRPG | ACAACAGAACAATATTGGAATGGTAATAGGAGGAAATAGTATCATCATGTTAGAAGC | SEQ ID NO: 556 | Homo sapiens small nuclear ribonucleoprotein polypeptide G (SNRPG), mRNA [NM_003096] |
| 557 | A_23_P108835 | YPEL5 | AAAGTGACTTCTGAGTGACATTAAGTTCGTCCTCTATTTGGCACTGGGCTGTTGGTTAGAAG | SEQ ID NO: 557 | Homo sapiens yippee-like 5 (Drosophila) (YPEL5), mRNA [NM_016061] |
| 558 | A_23_P110704 | SLU7 | CCTCTTTCCTTGGACAGTAGGACAACTAGTCAGAAGAAGACCATCCAAGATAGAATGCAGGTGATA | SEQ ID NO: 558 | Homo sapiens SLU7 splicing factor homolog (S. cerevisiae) (SLU7), mRNA [NM_006425] |
| 559 | A_23_P111583 | CD36 | CTTTGGCTTAATGAGACATGGGACCATTGGTGATGAGAAGGAGCAAACATGTCAGAAGTCAA | SEQ ID NO: 559 | Homo sapiens CD36 molecule (thrombospondin receptor) (CD36), transcript variant 2, mRNA [NM_001001547] |
| 560 | A_23_P115872 | CEP55 | GTAAACGAAAAACTTTTAAATTTCTTCAGGTTTTGTAACATGCTTACCACTGGGCTACTG | SEQ ID NO: 560 | Homo sapiens centrosomal protein 55kDa (CEP55), mRNA [NM_018131] |
| 561 | A_23_P117852 | KIAA0101 | TACTGCTGCCATTTTTATTGGTGTTGATTATTGATTTGGAATGGTGCCATATTGTCAGTCGTTC | SEQ ID NO: 561 | Homo sapiens KIAA0101 (KIAA0101), transcript variant 1, mRNA [NM_014736] |
| 562 | A_23_P118061 | CKLF | GCACAAGGCCCTGAACCATATATTGTTATCACTGGATTTGAAGTCACCGTTATCTTATTT | SEQ ID NO: 562 | Homo sapiens chemokine-like factor (CKLF), transcript variant 4, mRNA [NM_181641] |
| 563 | A_23_P118150 | ARL6IP1 | TTCAGATTTTCAGCTGACATTAGCTATAGTATACAGTAGGTTAAGACTCATGTGTATGAG | SEQ ID NO: 563 | Homo sapiens ADP-ribosylation factor-like 6 interacting protein 1 (ARL6IP1), mRNA [NM_015161] |
| 564 | A_23_P119992 | VRK2 | TTTAAGTTTCCAGCTGTTCACCGAAATGTGTATTCTTATTTCAGTGTTTCCTTCCAGAG | SEQ ID NO: 564 | Homo sapiens vaccinia related kinase 2 (VRK2), mRNA [NM_006296] |

Fig. 1-32

| No. | Probe ID No. | Symbols of genes | Sequence | SEQ ID NO: | Descriptions of genes (letters and numbers within [ ] indicates GenBank accession No.) |
|---|---|---|---|---|---|
| 565 | A_23_P120316 | MTHFD2 | AGGATATTCCTTGGTATTAGTACTCATTTTATGTATGTTACCCTTCAGTAAGTTCTCCC | SEQ ID NO: 565 | Homo sapiens methylenetetrahydrofolate dehydrogenase (NADP+ dependent) 2, methenyltetrahydrofolate cyclohydrolase (MTHFD2), nuclear gene encoding mitochondrial protein, transcript variant 1, mRNA [NM_006636] |
| 566 | A_23_P120644 | A_23_P120644 | GGCTTTGTTGTAGGAGGACCAATGACTGTTGTTATATCATGTATCGAGAATTCTGGGCAAAAC | SEQ ID NO: 566 | |
| 567 | A_23_P121253 | TNFSF10 | GGAAGAATCCATCTCTCAAGTAGTGTATGCAACAGTAGTAGCCTGAAGGTTTCCTTAAGGGA | SEQ ID NO: 567 | Homo sapiens tumor necrosis factor (ligand) superfamily, member 10 (TNFSF10), mRNA [NM_003810] |
| 568 | A_23_P121622 | SULT1B1 | GAAATAGAGATTGTGTGTAGTTGATTGAAAGGAGGGCAGTTATGAATTGATTTGGGGAAT | SEQ ID NO: 568 | Homo sapiens mRNA for SULT1B2, complete cds. [D89479] |
| 569 | A_23_P122007 | C5orf30 | ATCAGATTTCTCGTTGGGCTGGAAATGTTCGGCTGTTGTATATTTAAAGTAAATTGCAC | SEQ ID NO: 569 | Homo sapiens chromosome 5 open reading frame 30 (C5orf30), mRNA [NM_033211] |
| 570 | A_23_P123608 | JAK2 | GGATAACATGGCTGGATGAAAGAAATGACCTTCATTCTGAGACCAAAGTAGATTTACAGA | SEQ ID NO: 570 | Homo sapiens Janus kinase 2 (a protein tyrosine kinase) (JAK2), mRNA [NM_004972] |
| 571 | A_23_P124823 | THC2510119 | GGAAGAGAGATTCCTATAAGTTCACCGAGTCTTGAAGATTCGAAAATTTGTTGTTTAT | SEQ ID NO: 571 | BC000359 SPC18 protein [Homo sapiens] [exp=-1; wgp=0; cg=0], partial (77%) [THC2510119] |
| 572 | A_23_P126057 | SCP2 | ACATTGGCAAATAGCGTGGGATAGATTGTTGTTAATGGGTGTGACCAATCCGTGTTTT | SEQ ID NO: 572 | Homo sapiens sterol carrier protein 2 (SCP2), transcript variant 1, mRNA [NM_002979] |
| 573 | A_23_P127195 | PRPF18 | TGAGTTCTACCTGACTGATGTAACTCTTGATTGGTTTTAAGAACTTTGTTGGCCTTCATTCAT | SEQ ID NO: 573 | Homo sapiens PRPF18 pre-mRNA processing factor 18 homolog (S. cerevisiae) (PRPF18), mRNA [NM_003675] |
| 574 | A_23_P128192 | PFDN5 | CACGTCCATTGCTCAGCTCAAAGTGGTACAGAGACCAAGTATGTGGAAGCCAAGGACTGTCT | SEQ ID NO: 574 | Homo sapiens prefoldin subunit 5 (PFDN5), transcript variant 1, mRNA [NM_002624] |
| 575 | A_23_P128384 | VPS29 | CAAGCTAATTGGAGGATGATGTGAAAGTAGAAGGAATGAATACAAAAAACGTTAAAGCCAA | SEQ ID NO: 575 | Homo sapiens vacuolar protein sorting 29 homolog (S. cerevisiae) (VPS29), transcript variant 2, mRNA [NM_057180] |
| 576 | A_23_P128447 | LRRK2 | GGAGAAAGAGATACAATCCTTGCTTGAGCGTTTGGGACATCAATCTTCCACATGAAGTGCA | SEQ ID NO: 576 | Homo sapiens leucine-rich repeat kinase 2 (LRRK2), mRNA [NM_198578] |
| 577 | A_23_P130089 | IFT20 | TGGCCAGTTTCAGAAAATAGTTGGTGGTTTAATTGAGCTTGTTGACGAACATGCAAAACAGA | SEQ ID NO: 577 | Homo sapiens intraflagellar transport 20 homolog (Chlamydomonas) (IFT20), mRNA [NM_174887] |
| 578 | A_23_P130293 | ANKRD12 | TCAAGCATTTTACGAAAATCGAAGGAGTTTATGTTCGCGTTGTTGATGTTACGAGGGACTTTG | SEQ ID NO: 578 | Homo sapiens ankyrin repeat domain 12 (ANKRD12), mRNA [NM_015208] |
| 579 | A_23_P130444 | ZNF701 | CTCCTTGCAGAATACATCAATAACGTTCATTTTGAGGTAATAGTTACAAATGGCGGTGAGGAC | SEQ ID NO: 579 | Homo sapiens zinc finger protein 701 (ZNF701), mRNA [NM_018260] |
| 580 | A_23_P13065 | ZDHHC13 | CATACAATCTTGGATTCGATGGAGAAGCCTGGCAGAGATTTCTTTCAGTGTGGCTGCTTTGGCT | SEQ ID NO: 580 | Homo sapiens zinc finger, DHHC-type containing 13 (ZDHHC13), transcript variant 1, mRNA [NM_019028] |
| 581 | A_23_P132863 | ENST00000306024 | AGCTAAATGGTATTTTGATTTTCTGAAGGTCTCCAATAAATATGACCACCAAGAGATGCAAG | SEQ ID NO: 581 | U6 snRNA-associated Sm-like protein LSm3. [Source:Uniprot/SWISSPROT:Acc:P62310] [ENST00000306024] |
| 582 | A_23_P132935 | SPCS3 | GAATGTCAGTTTGACCCTGTCTTGGAACGTCGTACCAAATGCTGGAATTCTACCTCTTGT | SEQ ID NO: 582 | Homo sapiens signal peptidase complex subunit 3 homolog (S. cerevisiae) (SPCS3), mRNA [NM_021928] |

Fig. 1-33

| No. | Probe ID No. | Symbols of genes | Sequence | SEQ ID NO: | Descriptions of genes (letters and numbers within [ ] indicates GenBank accession No.) |
|---|---|---|---|---|---|
| 583 | A_23_P133438 | FAM105A | TGAGCATGGAAGGAATTAGGAGAGCTTTCTTCAGGATTACAGGTACAGTGGATGCAGGCAT | SEQ ID NO: 583 | Homo sapiens family with sequence similarity 105, member A (FAM105A), mRNA [NM_019018] |
| 584 | A_23_P133648 | FAM8A1 | AGTTCGGCGGGAATTAGAAATGAGTGTTTTAGATCAAGTGACGGTAAAGGATTTGTT | SEQ ID NO: 584 | Homo sapiens family with sequence similarity 8, member A1 (FAM8A1), mRNA [NM_016255] |
| 585 | A_23_P134247 | RHEB | GTGGATGTTTTTCGAAGGATAATAATTTGGAGGAGAAAAATGGACGGGGGCAGCTTCACAA | SEQ ID NO: 585 | Homo sapiens Ras homolog enriched in brain (RHEB), mRNA [NM_005614] |
| 586 | A_23_P13701 | TMBIM4 | TGCAGATCGGAATGGGCTTTCTGAGAAAAGTGTACAAGGATTCTTCTCTGCAGGTGTCT | SEQ ID NO: 586 | Homo sapiens transmembrane BAX inhibitor motif containing 4 (TMBIM4), mRNA [NM_016056] |
| 587 | A_23_P137016 | SAT1 | GAAATAATAGAATTGAGGACAGCCATTCCAAAGGTTTATTACCAGTGGCGTTGTTGGATGTTT | SEQ ID NO: 587 | Homo sapiens spermidine/spermine N1-acetyltransferase 1 (SAT1), mRNA [NM_002970] |
| 588 | A_23_P138308 | CD58 | AACCTGTATCCGAAGGCAGGGGTCATTCAAGACACAGATATGGACTTATACCATACCATT | SEQ ID NO: 588 | Homo sapiens CD58 molecule (CD58), mRNA [NM_001779] |
| 589 | A_23_P138507 | CDC2 | CCCATGTCAAAAACTTGGATGAAAATGGGCTTGGATTTGCTCTCGAAAAATGTTAATCTATG | SEQ ID NO: 589 | Homo sapiens cell division cycle 2, G1 to S and G2 to M (CDC2), transcript variant 1, mRNA [NM_001786] |
| 590 | A_23_P140301 | PSMA3 | TGAACTAGAACTCAGCTGGGTTGGGTGAATTAACTAATGGAAGACATGAAATTGTTCGAAA | SEQ ID NO: 590 | Homo sapiens proteasome (prosome, macropain) subunit, alpha type, 3 (PSMA3), transcript variant 1, mRNA [NM_002788] |
| 591 | A_23_P140423 | NDUFB1 | GGATGTTATTTAGACAGAAGAGTGATGATGAAGGCTAAGTGCCTCCGGAACAGAGTATG | SEQ ID NO: 591 | Homo sapiens NADH dehydrogenase (ubiquinone) 1 beta subcomplex, 1, 7kDa (NDUFB1), mRNA [NM_004545] |
| 592 | A_23_P142560 | ZEB2 | CTTTTAATCTGTGTTCTGCAAGTGCGCATGGTGCATGTGTACAGTGTTAAGAGGGTAACATGGGT | SEQ ID NO: 592 | Homo sapiens zinc finger E-box binding homeobox 2 (ZEB2), mRNA [NM_014795] |
| 593 | A_23_P144145 | DCUN1D1 | TCTTTAGTGAAATATCATCGTGCATATCTCGTGTAAGTTCAATTGTGTTTCTTACAGTCCCTG | SEQ ID NO: 593 | Homo sapiens RP42 protein mRNA, complete cds. [AF292100] |
| 594 | A_23_P144224 | TLOC1 | ATGGGATTGTGAAGAGGATGGAGATGGAAAATGATGGAGAAACACGTAAATCTTCAC | SEQ ID NO: 594 | Homo sapiens translocation protein 1 (TLOC1), mRNA [NM_003262] |
| 595 | A_23_P14564 | GPR65 | AACAAGTTAAATTGTTGTTGCTGATCGAATCTGTACTGTTTTGTAACGGAAACAGGAAG | SEQ ID NO: 595 | Homo sapiens G protein-coupled receptor 65 (GPR65), mRNA [NM_003608] |
| 596 | A_23_P145777 | NDUFA4 | ACGGCTGCTTTAGAATGAAGGTCTTCCAGAAGCCACATCCGCACAATTTTCCACTTAACCA | SEQ ID NO: 596 | Homo sapiens NADH dehydrogenase (ubiquinone) 1 alpha subcomplex, 4, 9kDa (NDUFA4), nuclear gene encoding mitochondrial protein, mRNA [NM_002489] |
| 597 | A_23_P14734 | RPS27L | TACAAGATGACCACAGGGTTTCAGGCATGGTCACAGAGACAGTGGTTCTTTGTGTAGGTTGTTCA | SEQ ID NO: 597 | Homo sapiens ribosomal protein S27-like (RPS27L), mRNA [NM_015920] |
| 598 | A_23_P147404 | A_23_P147404 | TGGGGTGAACATGAAATTGATTACATTTGTTGGAGATGGTGAGCAGCGTCCTCAGTGTG | SEQ ID NO: 598 | |
| 599 | A_23_P148273 | RP11-217H1.1 | GGTCCCAAGATATAAGACACTTGGAGTACTGGAAATTGAAAACGAAAATCGTGTGT | SEQ ID NO: 599 | Homo sapiens implantation-associated protein (DKFZp564K142), mRNA [NM_032121] |
| 600 | A_23_P148297 | SH3BGRL | ATAAAACAGGTTGGCGATCATTTCCAAGATTGGTTTCCCTTGAGTTTTGCTAAAAGAA | SEQ ID NO: 600 | Homo sapiens SH3 domain binding glutamic acid-rich protein like (SH3BGRL), mRNA [NM_003022] |
| 601 | A_23_P149892 | GALNACT-2 | CATGGTGATTCAGAATAGAATGAGGCATAGGATGGTGGTTTGTTGTTTGCTTCAATTTTC | SEQ ID NO: 601 | Homo sapiens chondroitin sulfate GalNAcT-2 (GALNACT-2), mRNA [NM_018590] |

Fig. 1-34

| No. | Probe ID No. | Symbols of genes | Sequence | SEQ ID NO: | Descriptions of genes (letters and numbers within [ ] indicates GenBank accession No.) |
|---|---|---|---|---|---|
| 602 | A_23_P152002 | BCL2A1 | TGTAACCCATATTTGCATTTGAAGGTATTCTGATCAAAGAAACTTCTACGAACAGCAAATTGC | SEQ ID NO: 602 | Homo sapiens BCL2-related protein A1 (BCL2A1), mRNA [NM_004049] |
| 603 | A_23_P154235 | NMI | CCATGTTTCTGAATCTCTTCTTTGTTTGAAATGGTGGTGCATGTTTTGAACTACGAATAAGTG | SEQ ID NO: 603 | Homo sapiens N-myc (and STAT) interactor (NMI), mRNA [NM_004688] |
| 604 | A_23_P154832 | ATP5J | TACAAATCTAAGCGACGACATCTGGAGGACGTGTTGATGCTAGTTCAGAGTATCAGGAA | SEQ ID NO: 604 | Homo sapiens ATP synthase, H+ transporting, mitochondrial F0 complex, subunit F6 (ATP5J), nuclear gene encoding mitochondrial protein, transcript variant 1, mRNA [NM_001003703] |
| 605 | A_23_P15564 | AMZ2 | AAACCCGTGGAAGGCTTTAAGGAATGAAAGAGAGTGGATATAAAATGCCTGGCTGTTCTC | SEQ ID NO: 605 | Homo sapiens archaemetzincins-2 (AMZ2), transcript variant 1, mRNA [NM_016627] |
| 606 | A_23_P155677 | HIP2 | GATTTTGGGGTCTATAGAGATTGGTTTATTGGATAGTTCAAGTCATTCTTGCTTGCACTT | SEQ ID NO: 606 | Homo sapiens huntingtin interacting protein 2 (HIP2), mRNA [NM_005339] |
| 607 | A_23_P165765 | HMGB2 | TAAAAATGGAGGTTGTAGGCTTTTTTGATGGGCTACTCATACAGTTACATTTTACAGCTC | SEQ ID NO: 307 | Homo sapiens high-mobility group box 2 (HMGB2), mRNA [NM_002129] |
| 608 | A_23_P155815 | NCAPG | AAGTTAGGAAAGACGATGGAGGTGGAATCCTTTAAGAATTATGCCAGTATTTGCTTTAA | SEQ ID NO: 608 | Homo sapiens non-SMC condensin I complex, subunit G (NCAPG), mRNA [NM_022346] |
| 609 | A_23_P157452 | POLR2K | GGAATGTCTTCACTTATACTTGGATTTGCTCTCTTCCCATTTGTGATGTTGTATAGGCTT | SEQ ID NO: 609 | Homo sapiens polymerase (RNA) II (DNA directed) polypeptide K, 7.0kDa (POLR2K), mRNA [NM_005034] |
| 610 | A_23_P159839 | C1GALT1C1 | TCCAAATCAGATCATGATGATGATGTATGGGGTATACCGCCTTAGGGGCATTTGGGCATAT | SEQ ID NO: 610 | Homo sapiens C1GALT1-specific chaperone 1 (C1GALT1C1), transcript variant 1, mRNA [NM_152692] |
| 611 | A_23_P163216 | ATP8B4 | ATCAGTGTATTTTCCATAAAGTGATTGGGGCATATTTGTGTGAAAAGGTCAGTTGTGTCA | SEQ ID NO: 611 | Homo sapiens ATPase, Class I, type 8B, member 4 (ATP8B4), mRNA [NM_024837] |
| 612 | A_23_P165402 | SF3B14 | CATGTGATCACGTATCGGGATTCAATGTTTGTAACAGATACCTTGTGGTTTGTACTATCA | SEQ ID NO: 612 | Homo sapiens splicing factor 3B, 14 kDa subunit (SF3B14), mRNA [NM_016047] |
| 613 | A_23_P165819 | A_23_P165819 | AGGATGTTGTTGTTGAAGTGTGGAGTTGTAACTCGTCGGTGGACTATGGACAGCACACAAT | SEQ ID NO: 613 | |
| 614 | A_23_P168592 | CCDC126 | GGGCAGTATCAGATAGCAGTTGAAAATCACGTTGTGCTGCTCCATCCACTGTGGATTATA | SEQ ID NO: 614 | Homo sapiens coiled-coil domain containing 126 (CCDC126), mRNA [NM_138771] |
| 615 | A_23_P169576 | EXOC6 | ATGCTGAATCTTCCCTTTGCCTTTCAGGATTTAGGCGTGTAAGAAACTATGCGTGATTC | SEQ ID NO: 615 | Homo sapiens exocyst complex component 6 (EXOC6), transcript variant 2, mRNA [NM_001013848] |
| 616 | A_23_P170233 | CSTA | AACTGGCTACTGAGTCATGATGATCCTTGCTGATAAATATAAGCATCAATAAAGAAGCATTCT | SEQ ID NO: 616 | Homo sapiens cystatin A (stefin A) (CSTA), mRNA [NM_005213] |
| 617 | A_23_P17287 | IAH1 | TGGGAGGATGGAGACCAATTAGCCAATGACAGGAGAGCCCAAATCTGCTTGTTATCTACAGAA | SEQ ID NO: 617 | Homo sapiens isoamyl acetate-hydrolyzing esterase 1 homolog (S. cerevisiae) (IAH1), mRNA [NM_001039613] |
| 618 | A_23_P18325 | PDCD10 | CCAACCGACTAATTCATCAAACCAACTTAATACTTCAGACCTTCAAACTGTGGCCTGAA | SEQ ID NO: 618 | Homo sapiens programmed cell death 10 (PDCD10), transcript variant 1, mRNA [NM_007217] |
| 619 | A_23_P200507 | CNIH4 | TGGTTGAAGTCAGGCTACGACAGTGCACAGTTGACGGAGGCAGAGAGTCGTTAAATCAT | SEQ ID NO: 619 | Homo sapiens cornichon homolog 4 (Drosophila) (CNIH4), mRNA [NM_014184] |

Fig. 1-35

| No. | Probe ID No. | Symbols of genes | Sequence | SEQ ID NO: | Descriptions of genes (letters and numbers within [ ] indicates GenBank accession No.) |
|---|---|---|---|---|---|
| 620 | A_23_P201758 | CD46 | GTCATGAGTGGAACGTGTGGCTTAGCTAATATTGCAATGTGGCTTGAATGTAGGTAGGCATC | SEQ ID NO: 620 | Homo sapiens CD46 molecule, complement regulatory protein (CD46), transcript variant a, mRNA [NM_002389] |
| 621 | A_23_P201918 | ABCB10 | CATGGATGAGGTAGACGCTAGAAGAAGTAATTAAGTCAATGTAAATCAAATGGAAGTTTTC | SEQ ID NO: 621 | Homo sapiens ATP-binding cassette, sub-family B (MDR/TAP), member 10 (ABCB10), nuclear gene encoding mitochondrial protein, mRNA [NM_012089] |
| 622 | A_23_P202750 | C11orf54 | TGCAAGGTTTCTGTATGCATTGGTCAACCAAAAGAGAGACGCATTCGATTGGGGGAGAATTA | SEQ ID NO: 622 | Homo sapiens chromosome 11 open reading frame 54 (C11orf54), mRNA [NM_014039] |
| 623 | A_23_P202978 | CASP1 | CTGTTCGTGTGATGTGGAGGAAAATTTTCCGGCAAGGTTCGATTTTCATTTGAGGAGCCAGA | SEQ ID NO: 623 | Homo sapiens caspase 1, apoptosis-related cysteine peptidase (interleukin 1, beta, convertase) (CASP1), transcript variant alpha, mRNA [NM_033292] |
| 624 | A_23_P203M | LSM1 | TGAGTGAAAGTGACATCCTGGGCACGTCACGCATTTGATCAGAGACTGTAGAGTTTTGAA | SEQ ID NO: 624 | Homo sapiens LSM1 homolog, U6 small nuclear RNA associated (S. cerevisiae) (LSM1), mRNA [NM_014462] |
| 625 | A_23_P204550 | SCYL2 | TGTGACTTCCCTGACTACGTTCGATATTTGATTTCAAATTGAAACTTCTGAAGGTTGCA | SEQ ID NO: 625 | Homo sapiens SCY1-like 2 (S. cerevisiae) (SCYL2), mRNA [NM_017988] |
| 626 | A_23_P205281 | C14orf2 | TGATAAAAGAAGTAAGGCTTTGAAAGGTTCAGGCGCTGCTCCTGGTCATCACTAACCAGA | SEQ ID NO: 626 | Homo sapiens chromosome 14 open reading frame 2 (C14orf2), mRNA [NM_004894] |
| 627 | A_23_P205768 | ARPP-19 | GGGCAATATTTGCCCATTCGTCTGGTGTAACTATGTGACTCAGTGCTTAACAGCTGCGATT | SEQ ID NO: 627 | Homo sapiens cyclic AMP phosphoprotein, 19 kD (ARPP-19), mRNA [NM_006628] |
| 628 | A_23_P206396 | CKLF | ATTATCAACTCACTCGGTAACAACAGTATTCATGCTCATGCTATCTGTGTTGGCACTGATA | SEQ ID NO: 628 | Homo sapiens chemokine-like factor (CKLF), transcript variant 1, mRNA [NM_016951] |
| 629 | A_23_P207445 | MAP2K6 | ACAGCATCAATAGAAAGATCATCTTTGAGATAATTTAACCCTGCCTCTCAGAGGGTTTTCT | SEQ ID NO: 629 | Homo sapiens mitogen-activated protein kinase kinase 6 (MAP2K6), mRNA [NM_002758] |
| 630 | A_23_P20882 | ATP6V1G1 | AGGTCCTTCGACTTTTTGGAGAGTAGGCAATGTAGCCTTTTTTGTACAGACTTAGAAATTA | SEQ ID NO: 630 | Homo sapiens ATPase, H+ transporting, lysosomal 13kDa, V1 subunit G1 (ATP6V1G1), mRNA [NM_004888] |
| 631 | A_23_P208866 | GMFG | GTCCAAGAAAAGTTGTCTTCTTTCGTTGATCTCTGGGCTGGGGACTGAATTCCTGATGT | SEQ ID NO: 631 | Homo sapiens glia maturation factor, gamma (GMFG), mRNA [NM_004877] |
| 632 | A_23_P210274 | PREI3 | GGATCAGTATGCGGTAGGATTTAGAGAATATTTCACATGCTTATTTCATCATCGGCAG | SEQ ID NO: 632 | Homo sapiens preimplantation protein 3 (PREI3), transcript variant 1, mRNA [NM_015387] |
| 633 | A_23_P211840 | UBE1C | GCCACCCTAGAGGGGAAAAAATAGAACACTTACTTACAGTCGGTAACCTCTATTGAAGAA | SEQ ID NO: 633 | Homo sapiens ubiquitin-activating enzyme E1C (UBA3 homolog, yeast) (UBE1C), transcript variant 1, mRNA [NM_003968] |
| 634 | A_23_P212706 | ATG3 | AAGACATCAGTCAGGATCATGTGAAGAAAACAGTGACCATTGAAAATCACCCTCATCTGC | SEQ ID NO: 634 | Homo sapiens ATG3 autophagy related 3 homolog (S. cerevisiae) (ATG3), mRNA [NM_022488] |
| 635 | A_23_P213247 | FBXL5 | ATGAAGGTGATTGGTTCTCTTTACACATTAACACTGTACCAAGCTTGGAGATCTTTTCG | SEQ ID NO: 635 | Homo sapiens F-box and leucine-rich repeat protein 5 (FBXL5), transcript variant 2, mRNA [NM_033535] |
| 636 | A_23_P213638 | PANK3 | TGTATATAGCCAGTGTTAAATCCTTAAATGGAATACAGAGCCTCGATTATTGAGCTGCTC | SEQ ID NO: 636 | Homo sapiens pantothenate kinase 3 (PANK3), mRNA [NM_024594] |
| 637 | A_23_P217236 | HMGB3 | GACCTGTTGACTCTGCAGGGGGCATCCATTTAGCTTCAGGTTGTCTTGTTTCTGTATATA | SEQ ID NO: 637 | Homo sapiens high-mobility group box 3 (HMGB3), mRNA [NM_005342] |

Fig. 1-36

| No. | Probe ID No. | Symbols of genes | Sequence | SEQ ID NO: | Descriptions of genes (Notes and numbers within [ ] indicates GenBank accession No.) |
|---|---|---|---|---|---|
| 638 | A_23_P22571 | SYBL1 | CAAACGGAATACGGTCAGCAGTCAACTCGAGGGTTTGGGCTTGAT TCCTGTTGAATAATA | SEQ ID NO: 638 | Homo sapiens synaptobrevin-like 1 (SYBL1), mRNA [NM_005638] |
| 639 | A_23_P24515 | ACAT1 | CAGGATTGTTGGTCATTGACTCATGGCTTGAAGCAAGGAGAATA CGGTCTTGCCAGTAT | SEQ ID NO: 639 | Homo sapiens acetyl-Coenzyme A acetyltransferase 1 (acetoacetyl Coenzyme A thiolase) (ACAT1), nuclear gene encoding mitochondrial protein, mRNA [NM_000019] |
| 640 | A_23_P250042 | SELT | GCAAGATAGTGTTTCAGTGGTGGCGATATTTTGGAATTCTGCACAT TCATGGAGTGCAATA | SEQ ID NO: 640 | Homo sapiens selenoprotein T (SELT), mRNA [NM_016275] |
| 641 | A_23_P250904 | UBQLN1 | CTTTGACAAACATCTCCAGGACAAAAGTGCCGGTTAGTCAGGTTTG TTGAAAATACAGTAG | SEQ ID NO: 641 | Homo sapiens ubiquilin 1 (UBQLN1), transcript variant 1, mRNA [NM_013438] |
| 642 | A_23_P251421 | CDCA7 | ATTTACTTGCATATGTAAACCATTGCTGTGCCATTCAATGTTTGA TGCATAATTGGACCT | SEQ ID NO: 642 | Homo sapiens cell division cycle associated 7 (CDCA7), transcript variant 1, mRNA [NM_031942] |
| 643 | A_23_P251945 | DCTN4 | ACACGTTGACATAGACTACAGACATGTCATGCCTTATGCAGGT AGCTGGTATTTATTC | SEQ ID NO: 643 | Homo sapiens dynactin 4 (p62) (DCTN4), mRNA [NM_016221] |
| 644 | A_23_P252145 | C1GALT1 | ATATGTGTATATATATGAGGAACTTGTGTTTTTTAAATGGTGGCC AGGTAGAGGAACTAG | SEQ ID NO: 644 | Homo sapiens core 1 synthase, glycoprotein-N-acetylgalactosamine 3-beta-galactosyltransferase, 1 (C1GALT1), mRNA [NM_020156] |
| 645 | A_23_P252371 | RBBP8 | GGCAAGGAGCAGAAGAGACATAGACGTTGAAACAGAAACAGAAGGAT GAAGGACAGTTTTT | SEQ ID NO: 645 | Homo sapiens retinoblastoma binding protein 8 (RBBP8), transcript variant 1, mRNA [NM_002894] |
| 646 | A_23_P253524 | CENPE | CTGAGTGCAAAACTCAGTAGACTGGTCTTGTGTCTTGTCACTTCTGTGGAG ATCAGCATTCCTA | SEQ ID NO: 646 | Homo sapiens centromere protein E, 312kDa (CENPE), mRNA [NM_001813] |
| 647 | A_23_P253223 | VBP1 | TGAACTCAGGCATGTTGGAAAAGAATTATGGACTGCCAGAAA GAATCTTGATTCCCT | SEQ ID NO: 647 | Homo sapiens von Hippel-Lindau binding protein 1 (VBP1), mRNA [NM_003372] |
| 648 | A_23_P256231 | FBXO30 | GCCTTTTAAAGTTTTGCTGGAGAATGTGTCTGTGGTTAGGATAGC AGAAGCATTAAGCTT | SEQ ID NO: 648 | Homo sapiens F-box protein 30 (FBXO30), mRNA [NM_032145] |
| 649 | A_23_P253866 | DCP2 | CCGTGGCATGCTAATGGACATTGGACAAGTTGCCCTTTTCATCCAGAG CGTTTTTGAGTTCA | SEQ ID NO: 649 | Homo sapiens DCP2 decapping enzyme homolog (S. cerevisiae) (DCP2), mRNA [NM_152624] |
| 650 | A_23_P25735 | PSMA6 | TAGGAGAGAGGACTAAACATTGCGTTAGTTTAGGAGATCCGTG ATGCCAGTTACGTGT | SEQ ID NO: 650 | Homo sapiens proteasome (prosome, macropain) subunit, alpha type, 6 (PSMA6), mRNA [NM_002791] |
| 651 | A_23_P258814 | ENST00000328644 | GGAAGGTGTGGCAATGTGTCCAGGCTGCTCTCTCATTATAAAAGT GATTTATGACAAGA | SEQ ID NO: 651 | DPH3 homolog B (CSL-type zinc finger-containing protein 1). [Source:Uniprot/SWISSPROT;Acc:Q9H4G8] [ENST00000328644] |
| 652 | A_23_P259272 | WSB2 | AACGTTACGATGAGTCGTTGGAGAAAAGTTGAGGAATTTGCTGTACCA CGTTGTTGCTGAA | SEQ ID NO: 652 | Homo sapiens WD repeat and SOCS box-containing 2 (WSB2), mRNA [NM_018639] |
| 653 | A_23_P259521 | WDR41 | TTCGGCAGTTTAAGATTATTTCAAAAATTAGAGGAGAATGGTGAC TTATACGTTGGTGTG | SEQ ID NO: 653 | Homo sapiens WD repeat domain 41 (WDR41), mRNA [NM_018268] |
| 654 | A_23_P2705 | P2RY5 | TCTGTATTGCTGTTTCCAACTGTTGTTTGACCGTATAGTTTACT ACTTTACTCGGACA | SEQ ID NO: 654 | Homo sapiens purinergic receptor P2Y, G-protein coupled, 5 (P2RY5), mRNA [NM_005767] |
| 655 | A_23_P28664 | KIAA1212 | GGGACTTCTCTATGATAGACGGACAACTAAGGCTGAGTTTTTGAGAC CTGGTCGTCGAAAAA | SEQ ID NO: 655 | Homo sapiens KIAA1212 (KIAA1212), mRNA [NM_018084] |
| 656 | A_23_P29005 | SAMSN1 | CTCTGGTTGCTATATCTCATCAGGAAATTCAGATAATGGCAAAGA GGATCTGGAGTCTGA | SEQ ID NO: 656 | Homo sapiens SAM domain, SH3 domain and nuclear localization signals 1 (SAMSN1), mRNA [NM_022136] |

Fig. 1-37

| No. | Probe ID No. | Symbols of genes | Sequence | SEQ ID NO: | Descriptions of genes (letters and numbers within [ ] indicates GenBank accession No.) |
|---|---|---|---|---|---|
| 657 | A_23_P30069 | FLJ31033 | AGATTTGTTTAAGTGCGCTACACTTTCTTATTTCTAAATGATCAAGAGTACAGTTCCTGG | SEQ ID NO: 657 | Homo sapiens cDNA FLJ13681 fis, clone PLACE2000014, weakly similar to HYPOTHETICAL HELICASE C28H8.3 IN CHROMOSOME III. [AK023743] |
| 658 | A_23_P30338 | CCNH | AGGTCTCAAAGAAATCAAAACATGAGGAGGAAGAATGGACTGATGAGGACGTGGTAGAAT | SEQ ID NO: 658 | Homo sapiens cyclin H (CCNH), mRNA [NM_001239] |
| 659 | A_23_P304287 | PSMC2 | GATCCAGCAGCTGATGAGGCCAGGGACAGATGGATAGAAAAATTGAATTTAGCTTGCGCGAT | SEQ ID NO: 659 | Homo sapiens proteasome (prosome, macropain) 26S subunit, ATPase, 2 (PSMC2), mRNA [NM_002803] |
| 660 | A_23_P305759 | ABHD3 | AGTCCTAGACGTGAAGTCAGTAGGAATTCCAGTATTGTGTCTAAATTCTGTGGATGATGTT | SEQ ID NO: 660 | Homo sapiens abhydrolase domain containing 3 (ABHD3), mRNA [NM_138340] |
| 661 | A_23_P307940 | CAPZA2 | CTACAAGATTGGCAAAGAGATGCAGAATGGATAAGATGAACATTGGATGACCGGATGATT | SEQ ID NO: 661 | Homo sapiens capping protein (actin filament) muscle Z-line, alpha 2 (CAPZA2), mRNA [NM_006136] |
| 662 | A_23_P31097 | OSTM1 | ACTGAAAATGTGCTGGGGTTTGTTCTGGTCGTCACTGTTTATGCTGCTGGAAGTTAGCACT | SEQ ID NO: 662 | Homo sapiens osteopetrosis associated transmembrane protein 1 (OSTM1), mRNA [NM_014028] |
| 663 | A_23_P31315 | CBX3 | GCGTTGGAAGAGTTGTTGGGGGTTTTTGCATCCATAGCACTGGTTAGTTTGAACAAATA | SEQ ID NO: 663 | Homo sapiens chromobox homolog 3 (HP1 gamma homolog, Drosophila) (CBX3), transcript variant 2, mRNA [NM_016587] |
| 664 | A_23_P314202 | PAPD4 | TCTGTGTAGAAGAAAGCTTTTGATGGAACAAATACAGCGCAGAGCAGTGCACGAAAAGCAGA | SEQ ID NO: 664 | Homo sapiens PAP associated domain containing 4 (PAPD4), mRNA [NM_173797] |
| 665 | A_23_P316601 | RIT1 | TGGTTGCTTGCTCTTTCAGTTCAGTTAACTGATAAGAGAGCAGATGCCTACTAGGAGTTTTTTAAGTGA | SEQ ID NO: 665 | Homo sapiens Ras-like without CAAX 1 (RIT1), mRNA [NM_006912] |
| 666 | A_23_P31671 | UQCRB | AAGCCATAAGAAGAGCTTCCTGAGAACCTTTATAATGACGAGGATGTTTCGCATTAAGAGGG | SEQ ID NO: 666 | Homo sapiens ubiquinol-cytochrome c reductase binding protein (UQCRB), mRNA [NM_006294] |
| 667 | A_23_P324633 | C9orf72 | TTTGTGGATTTAGTCCGTGGGGATTCCAGTCGTGTAGAAATGTCTAATAGTCTCTATAGTCC | SEQ ID NO: 667 | Homo sapiens chromosome 9 open reading frame 72 (C9orf72), transcript variant 1, mRNA [NM_018325] |
| 668 | A_23_P32577 | DACH1 | AATATTAATGTCTAGTTGTTCTATATATTATAACCACATTTGCGCTCTATGCAAGCCCTGG | SEQ ID NO: 668 | Homo sapiens dachshund homolog 1 (Drosophila) (DACH1), transcript variant 1, mRNA [NM_080759] |
| 669 | A_23_P326170 | CALM2 | TAAACTTTGTTTAGGCACTTAAAATCTGCTTATGGACAATTTGGCTCAAAATGCATTCC | SEQ ID NO: 669 | Homo sapiens calmodulin 2 (phosphorylase kinase, delta) (CALM2), mRNA [NM_001743] |
| 670 | A_23_P328511 | HSBP1 | TTTCTTGAAGATGGTATCTTCAGATGTTGGACCTTGGTCAGTTGTGCTATTCATTATTAA | SEQ ID NO: 670 | Homo sapiens heat shock factor binding protein 1 (HSBP1), mRNA [NM_001537] |
| 671 | A_23_P329198 | OBFC2A | ACATGTCATAAGTGCTGTACCGACTTTCCCGTTTTTACTGTCAGGGTGGATAACTCTTAGGATT | SEQ ID NO: 671 | Homo sapiens oligonucleotide/oligosaccharide-binding fold containing 2A (OBFC2A), mRNA [NM_001031716] |
| 672 | A_23_P339480 | HAT1 | AACATGAAGAGCTGGAAGAGAGTTTCAGGAAGTAGTGGAAGATTACCGGCGGTGTTATTG | SEQ ID NO: 672 | Homo sapiens histone acetyltransferase 1 (HAT1), transcript variant 1, mRNA [NM_003642] |
| 673 | A_23_P339557 | MLSTD2 | GGGGCAATGTAAATCTAACCTCAGAATCATCATGTTTTATATCATTACTGGATTGCTGTAAGCC | SEQ ID NO: 673 | Homo sapiens male sterility domain containing 2 (MLSTD2), mRNA [NM_032228] |
| 674 | A_23_P344973 | MYL6 | CCTATGAGGATTATGTCGAAGGAACTTCGGGTGTTGACAAGGAAGGAAATGGCAGGGTCA | SEQ ID NO: 674 | Homo sapiens myosin, light chain 6, alkali, smooth muscle and non-muscle (MYL6), transcript variant 2, mRNA [NM_079423] |
| 675 | A_23_P345591 | PSMA2 | GCCTGGAAAAGCTACAGCAATGGGAAAGAAGTATGTGAATGGGAAGACTTTCCTTGAGAAA | SEQ ID NO: 675 | Homo sapiens proteasome (prosome, macropain) subunit, alpha type, 2 (PSMA2), mRNA [NM_002787] |

Fig. 1-38

| No. | Probe ID No. | Symbols of genes | Sequence | SEQ ID NO: | Descriptions of genes [letters and numbers within ] indicates GenBank accession No.) |
|---|---|---|---|---|---|
| 676 | A_23_P340006 | CCPG1 | TATGGTGGACTAATGGAAGACAAATGGGAAATCTTGAAATAGAATTGGGGCAATTACCT | SEQ ID NO: 676 | Homo sapiens cell cycle progression 1 (CCPG1), transcript variant 2, mRNA [NM_020739] |
| 677 | A_23_P34628 | GTF2B | TGTTACAATCAGACAGTCCTATAGACTGATCTATCCTCGAGCCCCAGATCTGTTTCCTAC | SEQ ID NO: 677 | Homo sapiens general transcription factor IIB (GTF2B), mRNA [NM_001514] |
| 678 | A_23_P351903 | TMEM167 | AAACTGGATTGTTGGGTATATTTTGGAAGTGTGCCAAGAATTGGGTGAACGGAAGAGTCCTT | SEQ ID NO: 678 | Homo sapiens transmembrane protein 167 (TMEM167), mRNA [NM_174909] |
| 679 | A_23_P355067 | TMCO1 | AACTCAAGAACTCTTTATTTCTATCATTCTTCTGAGACACACAACATCAGACTGGCAA | SEQ ID NO: 679 | Homo sapiens transmembrane and coiled-coil domains 1 (TMCO1), mRNA [NM_019026] |
| 680 | A_23_P355244 | SAMD9 | TCACTGGAGGAAGAATTTTCCCTTGGTGTGCATAAAATTTTAACTCCATAACTTATAAGC | SEQ ID NO: 680 | Homo sapiens sterile alpha motif domain containing 9 (SAMD9), mRNA [NM_017654] |
| 681 | A_23_P357995 | ZBTB8OS | ATCAATTGGGTGGGGAGAAGAATTTTCATTGTGCAAGGACGCTCAGGGAACAGAAGTCAA | SEQ ID NO: 681 | Homo sapiens zinc finger and BTB domain containing 8 opposite strand (ZBTB8OS), mRNA [NM_178547] |
| 682 | A_23_P371266 | DNM3 | ACTGTCTTCTTGGGCACTTTCAGGGATTTCTTAATGCTGATATATGGACTCTTAGAATGGAA | SEQ ID NO: 682 | Homo sapiens dynamin 3 (DNM3), mRNA [NM_015569] |
| 683 | A_23_P37441 | B2M | TTGTCTTCAGCAGGAGTGGTCTTCTTCGTGTCGTCGTCGTAGTACAGTGAATTCACCCCACT | SEQ ID NO: 683 | Homo sapiens beta-2-microglobulin (B2M), mRNA [NM_004048] |
| 684 | A_23_P37535 | RAB8B | AGCCTTTCCCTATTTCAGGACGAATCTAGACTCATATTTGGCACAGTTTGTGTCGTGAAG | SEQ ID NO: 684 | Homo sapiens RAB8B, member RAS oncogene family (RAB8B), mRNA [NM_016530] |
| 685 | A_23_P378722 | SAT1 | GCATGTACTATTTACCTATGACCCGTGGATTGGCAAGTTATTGTATCTTGAGGACTTCT | SEQ ID NO: 685 | Homo sapiens spermidine/spermine N1-acetyltransferase 1 (SAT1), mRNA [NM_002970] |
| 686 | A_23_P380848 | TXNL5 | CTGGTGGAAATGTGTCTCTGAAGTTAAGATTAGGATGGAATCATGTGTTGATGT | SEQ ID NO: 686 | Homo sapiens thioredoxin-like 5 (TXNL5), mRNA [NM_032731] |
| 687 | A_23_P389118 | TMEM16F | TATGTTTGAGAGGGGTAAAATGTATGAGCAGCTTAACTGAAGTAGAAGTATTCATGATGC | SEQ ID NO: 687 | Homo sapiens transmembrane protein 16F (TMEM16F), mRNA [NM_001025356] |
| 688 | A_23_P406355 | FAM76B | AAACTGTGGAACAACTTCAGGCAAAACAGAGAACTACTCAAACAGGTCGAGCATTAT | SEQ ID NO: 688 | Homo sapiens family with sequence similarity 76, member B (FAM76B), mRNA [NM_144664] |
| 689 | A_23_P41114 | CSTA | AAACAAATGAGACTTATGGAAATTGGAAGGTGTGCAGTATAAAACTCAAGTTGTTGCTG | SEQ ID NO: 689 | Homo sapiens cystatin A (stefin A) (CSTA), mRNA [NM_005213] |
| 690 | A_23_P412392 | SEC22B | GTTTTGATGGCTTTTAAACAAGACTCCAGTATGTGAAGGTTAATTGCTGTCGTCGACA | SEQ ID NO: 690 | Homo sapiens SEC22 vesicle trafficking protein homolog B (S. cerevisiae) (SEC22B), mRNA [NM_004892] |
| 691 | A_23_P412980 | SNX13 | CCCATCTCAAGCAAGAATGGCGTTGGTTTCTCTGCATTTCAAACTAATCAGCATTCTCCA | SEQ ID NO: 691 | Homo sapiens sorting nexin 13 (SNX13), mRNA [NM_015132] |
| 692 | A_23_P41645 | ELL2 | TGTCTTTTCAAAGTGCTGCCAGTTGAAAGTGAAAGGGAAGCATTATGTTTACAAATCTGTTTGA | SEQ ID NO: 692 | Homo sapiens elongation factor, RNA polymerase II, 2 (ELL2), mRNA [NM_012081] |
| 693 | A_23_P419239 | ETNK1 | GGGCTTGGGACTGAAGTTAGTGAGTGCGTAAAAGCGGGAGGTAGAAATACTCTTCATTCAAGTCAATCA | SEQ ID NO: 693 | Homo sapiens ethanolamine kinase 1 (ETNK1), transcript variant 1, mRNA [NM_018638] |
| 694 | A_23_P422794 | NSMCE2 | CATTGTTCGATGATGAGTCGAAGGTCCAGGCAAAAGCGGGAAAGAAAAAGGCCTATGCCCTCAAAT | SEQ ID NO: 694 | Homo sapiens non-SMC element 2, MMS21 homolog (S. cerevisiae) (NSMCE2), mRNA [NM_173685] |
| 695 | A_23_P424080 | YIPF4 | AAAGCATTGTGTTTTTAAGATTGTCGATATTCACCTAAAAACTTGTGCCAAAAGCACG | SEQ ID NO: 695 | Homo sapiens Yip1 domain family, member 4 (YIPF4), mRNA [NM_032312] |

Fig. 1-39

| No. | Probe ID No. | Symbols of genes | Sequence | SEQ ID NO: | Descriptions of genes (letters and numbers within [ ] indicates GenBank accession No.) |
|---|---|---|---|---|---|
| 696 | A_23_P42514 | C6orf62 | TCGTTTGGAGTAAAAGTAGTGCTTACCCAGTTTCGAATGTATTTAGCTTCTGGTTGGAAT | SEQ ID NO: 696 | Uncharacterized protein C6orf62 (HBV X-transactivated gene 12 protein). [Source:Uniprot/SWISSPROT;Acc:Q9GZU0] [ENST00000378119] |
| 697 | A_23_P42491 | FLJ25416 | GCTTGGTCACCTGAATTGTTTTCATAAAAGTCACCTGAACGCAATTCCTGAACTTTTAA | SEQ ID NO: 697 | Homo sapiens hypothetical protein FLJ25416 (FLJ25416), mRNA [NM_145018] |
| 698 | A_23_P42975 | PRKAR2B | GCCACATTTTAGAAGACGTGTTTAACATTTTTGCAAAACCTTCTTGTAGGAAAAGAGAGC | SEQ ID NO: 698 | Homo sapiens protein kinase, cAMP-dependent, regulatory, type II, beta (PRKAR2B), mRNA [NM_002736] |
| 699 | A_23_P43049 | DCTN6 | AAATACATTTGAAGTCATCCCTGAGAATACGAGGTGATCTATGGTGCAGACTGCCTTCGTCG | SEQ ID NO: 699 | Homo sapiens dynactin 6 (DCTN6), mRNA [NM_006571] |
| 700 | A_23_P434768 | NUP50 | TATATCTCAGCTTGTATTAGTTTTTGAATGCTCCCATCGAGGAAGTGTAAGAATCCATG | SEQ ID NO: 700 | Homo sapiens nucleoporin 50kDa (NUP50), transcript variant 2, mRNA [NM_007172] |
| 701 | A_23_P434809 | S100A8 | AAAGCCATGAAGAAAGGCACAAAGAGATAGGTGAGTTACTGGGGCCAGAGGCTGGGCCCT | SEQ ID NO: 701 | Homo sapiens S100 calcium binding protein A8 (S100A8), mRNA [NM_002964] |
| 702 | A_23_P43846 | CIP29 | AAAGAGCAGAGCGCTTTGGGAATTGCCTGATGAAAAGTTCCTGATACTTCTGTTCTCAAG | SEQ ID NO: 702 | Homo sapiens cytokine induced protein 29 kDa (CIP29), mRNA [NM_030821] |
| 703 | A_23_P44768 | TBK1 | TCTACTCTGAGTGGGGCTAAATAAGTTATTTCTGTGACGGCTACTGGAAATATTTTA | SEQ ID NO: 703 | Homo sapiens TANK-binding kinase 1 (TBK1), mRNA [NM_013254] |
| 704 | A_23_P48887 | CCPG1 | AAGTCAGAAGAGCTCATATATATAATTCTAATGTCCCACCTATGTCCATTCCATATACCA | SEQ ID NO: 704 | Homo sapiens cell cycle progression restoration 8 protein (CPR8) mRNA, complete cds. [AF011794] |
| 705 | A_23_P500381 | HTR7 | TAACTCCCATTGACATTGTTCTTACGACAGAGATAGGGAGAAAAGTACCTTTCCTGAAAGGG | SEQ ID NO: 705 | Homo sapiens 5-hydroxytryptamine (serotonin) receptor 7 (adenylate cyclase-coupled) (HTR7), transcript variant d, mRNA [NM_019859] |
| 706 | A_23_P50108 | NDC80 | AAAGTGGGAAATAAGCTTGAAGGTCTCTTAGAGATGGTTGCTACACATGTTGGGTCTGTA | SEQ ID NO: 706 | Homo sapiens NDC80 homolog, kinetochore complex component (S. cerevisiae) (NDC80), mRNA [NM_006101] |
| 707 | A_23_P51009 | NDUFB3 | CCGGAATGAAGCTTGGAGATACATGGGTGGCTTGGAAAAGAGTGTTTCCTTTTCTGATGT | SEQ ID NO: 707 | Homo sapiens NADH dehydrogenase (ubiquinone) 1 beta subcomplex, 3, 12kDa (NDUFB3), mRNA [NM_002491] |
| 708 | A_23_P51487 | GBP3 | AATCCTAAAGACATAAGTAGTCTTTTCCTGATTGTTAAAGGTCATACTTGAAATCCTGCC | SEQ ID NO: 708 | Homo sapiens guanylate binding protein 3 (GBP3), mRNA [NM_018284] |
| 709 | A_23_P51572 | TSNAX | GAATGGGGACATTGATACCCCTTTGAAGTGAGGCAGTTTTACGTCAGGTTTATGATGG | SEQ ID NO: 709 | Homo sapiens translin-associated factor X (TSNAX), mRNA [NM_005999] |
| 710 | A_23_P5389 | LOC84661 | TACCTGATCAGACAGTTGTGCTATGTATTACAGGGACTTGCTGTGGTTGCAAAGGAA | SEQ ID NO: 710 | Homo sapiens dpy-30-like protein (LOC84661), mRNA [NM_032574] |
| 711 | A_23_P58390 | C4orf32 | TAATACTAAGTATTTAGTATACTGTCCAGTACTGTACATGTGACACTGGTGTTAATAGGG | SEQ ID NO: 711 | Homo sapiens chromosome 4 open reading frame 32 (C4orf32), mRNA [NM_152400] |
| 712 | A_23_P58396 | PDGFC | CATGGATATTTTATGTACAGAAGTAGTGTCTGTCTTAACCAGTTCACTTATTGTACTGGC | SEQ ID NO: 712 | Homo sapiens platelet derived growth factor C (PDGFC), mRNA [NM_016205] |
| 713 | A_23_P59921 | SUB1 | CAGATTGGGAAATGAGGTACGTTAGTGTTGTTCGCGATTTTAAAGGCAAAGTGCTAATTGAT | SEQ ID NO: 713 | Homo sapiens SUB1 homolog (S. cerevisiae) (SUB1), mRNA [NM_006713] |

Fig. 1-40

| No. | Probe ID No. | Symbols of genes | Sequence | SEQ ID NO: | Descriptions of genes (letters and numbers within [ ] indicates GenBank accession No.) |
|---|---|---|---|---|---|
| 714 | A_23_P60248 | TXN | GGACAAAAGGTGGGTGAATTTCTGGAGCCAATAAGAAAAGCTT GAAGCCACCATTAAT | SEQ ID NO: 714 | Homo sapiens thioredoxin (TXN), mRNA [NM_003329] |
| 715 | A_23_P63655 | ATP5C1 | AGAGAGGTGAAACCAGCTCGAATATATGGATTCGATCTTTAGCT CTGTATGAAAAAGCT | SEQ ID NO: 715 | Homo sapiens ATP synthase, H+ transporting, mitochondrial F1 complex, gamma polypeptide 1 (ATP5C1), nuclear gene encoding mitochondrial protein, transcript variant 2, mRNA [NM_005174] |
| 716 | A_23_P63896 | FAS | ATGTCTATCCACAGGCTAACCCCAGTCTATGAATCAATAGAAGAA GCTATGAACGTTTGC | SEQ ID NO: 716 | Homo sapiens Fas (TNF receptor superfamily, member 6) (FAS), transcript variant 1, mRNA [NM_000043] |
| 717 | A_23_P64129 | HTATIP2 | AAAGTCAGCATGTTTTAACTTGTTGTTTACTATCCTCAGGCAT CCATTCCAATCAACA | SEQ ID NO: 717 | Homo sapiens HIV-1 Tat interactive protein 2, 30kDa (HTATIP2), mRNA [NM_006410] |
| 718 | A_23_P65262 | RP11-298P3.3 | AGCCAAGACTTAAGAAGACTTAAGGCGTTCCCTTGAGGTACCA TTATGCAAGGGTT | SEQ ID NO: 718 | Human BRCA2 region, mRNA sequence CG016. [U50629] |
| 719 | A_23_P69188 | DPH3 | TGCTGTTCTGTAAGAGTGTGGATTCTTCGTATCGAAGTGCTGATAT CATCTCAGGAAGCA | SEQ ID NO: 719 | Homo sapiens DPH3, KTI11 homolog (S. cerevisiae) (DPH3), transcript variant 1, mRNA [NM_206831] |
| 720 | A_23_P69908 | GLRX | CTGATAAAACTTACAGCCCGCTACAGCAAGAGTGTATCGTGAAA GAGGTCCTACAGTTT | SEQ ID NO: 720 | Homo sapiens glutaredoxin (thioltransferase) (GLRX), mRNA [NM_002064] |
| 721 | A_23_P69958 | AP3S1 | GATCACAAGGTGCAGCATTCCTTAATTCCTTCTGGTATATGTCACA CAGTTGTTATTTGGA | SEQ ID NO: 721 | Homo sapiens adaptor-related protein complex 3, sigma 1 subunit (AP3S1), mRNA [NM_001284] |
| 722 | A_23_P70290 | TMEM30A | ATCTTCTGCTCAACTGTCAAACCACATGTAAGTGCTTAATGGAGA CTGTTTTCATTCTTG | SEQ ID NO: 722 | Homo sapiens transmembrane protein 30A (TMEM30A), mRNA [NM_018247] |
| 723 | A_23_P71117 | SLC25A40 | AGCCAAAGAAGATGGAGACTCTTAGGCAAGACTCTTGTTTTCACCAT TATTCTCACAATG | SEQ ID NO: 723 | Homo sapiens solute carrier family 25, member 40 (SLC25A40), mRNA [NM_018843] |
| 724 | A_23_P74799 | SLC25A24 | GATTCTGTATCTTTTGGAAAAAAGGCCAGAGAGTTGAAGATAGTATA TTTCTGGTAGTACTG | SEQ ID NO: 724 | Homo sapiens solute carrier family 25 (mitochondrial carrier; phosphate carrier), member 24 (SLC25A24), transcript variant 2, mRNA [NM_213651] |
| 725 | A_23_P75028 | REEP3 | AGAAACGAGCACACAAGTGTATTTTAGTCATCTACACGTCAAATAT CCCAAGACAGAATAT | SEQ ID NO: 725 | Homo sapiens receptor accessory protein 3 (REEP3), mRNA [NM_001001330] |
| 726 | A_23_P76480 | BF213738 | AAATCGAAACAGGACAACAATGGGTAGATGGAGCTACATTACCAAATC GTTTGGCATGACACGG | SEQ ID NO: 726 | BF213738 601847628F1 NIH_MGC_55 Homo sapiens cDNA clone IMAGE:4078519 5', mRNA sequence [BF213738] |
| 727 | A_23_P76799 | BAZ1A | TACACAGAATGAATGAATCCAATCTTATAAGCTTGAAGTGCTGTACCA GTGCTGGCTGCAGGT | SEQ ID NO: 727 | Homo sapiens bromodomain adjacent to zinc finger domain, 1A (BAZ1A), transcript variant 1, mRNA [NM_013448] |
| 728 | A_23_P77073 | SPPL2A | ATGTTCAGACTGGTTCTTCTTACAGTATACTATGTTTCGTCTACAG TTGCCTATGCTATTG | SEQ ID NO: 728 | Homo sapiens signal peptide peptidase-like 2A (SPPL2A), mRNA [NM_032802] |
| 729 | A_23_P77145 | RAB11A | TATAGAATATAGTCCAGTTAAATCTTTGGTTTCAGTATGTCAGTGTCGAA GAGTACAGTGAGAGG | SEQ ID NO: 729 | Homo sapiens RAB11A, member RAS oncogene family (RAB11A), mRNA [NM_004663] |
| 730 | A_23_P78092 | EVI2A | GGTGAATCAGACAGCTTGGAAAAAGAACAAAACAGGCTCACAGGACCC AACCTAGTGATGCAA | SEQ ID NO: 730 | Homo sapiens ecotropic viral integration site 2A (EVI2A), transcript variant 1, mRNA [NM_001003927] |

Fig. 1-41

| No. | Probe ID No. | Symbols of genes | Sequence | SEQ ID NO: | Descriptions of genes (letters and numbers within [ ] indicates GenBank accession No.) |
|---|---|---|---|---|---|
| 731 | A_23_P79199 | DBI | TGGTCAGGATAGGGGTCTAACAGATTAGGGGGGTAAACGATTACTGAGTTGGTTGAGTA | SEQ ID NO: 731 | Homo sapiens diazepam binding inhibitor (GABA receptor modulator, acyl-Coenzyme A binding protein) (DBI), transcript variant 1, mRNA [NM_020548] |
| 732 | A_23_P81212 | MRPS18C | ATGGGGTTTATGCCAGTTACATACAAGGATCCTGCATATCTCAAGGACCCTAAAGTTTGT | SEQ ID NO: 732 | Homo sapiens mitochondrial ribosomal protein S18C (MRPS18C), nuclear gene encoding mitochondrial protein, mRNA [NM_016067] |
| 733 | A_23_P81612 | SRP19 | AGGAAAGAAAAGAAGTAACCTAGTATACAGCATGAAGTATGTGGTACTACTGTAAGAGAC | SEQ ID NO: 733 | Homo sapiens signal recognition particle 19kDa (SRP19), mRNA [NM_003135] |
| 734 | A_23_P81690 | COX7A2 | AGCTCTCTATGGACCCAGTAATCTGATAAATAACCGAGGTCTTCTTTGGGGATCAATATT | SEQ ID NO: 734 | Homo sapiens cytochrome c oxidase subunit VIIa polypeptide 2 (liver) (COX7A2), mRNA [NM_001865] |
| 735 | A_23_P82674 | GBAS | TTACAAGTGTAGCCAATAACTGAAAATGTTTTAAGTCACTCTCATTGTAAGCAGTCCAC | SEQ ID NO: 735 | Homo sapiens glioblastoma amplified sequence (GBAS), mRNA [NM_001483] |
| 736 | A_23_P82748 | ENY2 | CATTCCTTGCTCAGCATGCCAGCCTTTAAGATGAATTAGATTGTGTTGTCTGTCGTTTTA | SEQ ID NO: 736 | Homo sapiens enhancer of yellow 2 homolog (Drosophila) (ENY2), mRNA [NM_020189] |
| 737 | A_23_P83073 | HIATL1 | AAACAACTCAAGCATTCTGGTGGCAACATAGAGATTGTAGGCTGCTTCTAAGAAAGTTAT | SEQ ID NO: 737 | Homo sapiens hippocampus abundant transcript-like 1 (HIATL1), mRNA [NM_032558] |
| 738 | A_23_P83175 | PTPLAD2 | CATCGTTTTTGTGGTCGATGACCAGTCAGGAAGTCCAAGAGAAATATGTTGGTGTGTGT | SEQ ID NO: 738 | Homo sapiens protein tyrosine phosphatase-like A domain containing 2 (PTPLAD2), mRNA [NM_001109015] |
| 739 | A_23_P83278 | CHMP5 | CATTGCTCTTTTATTTTTCCATTAAGAGACTCATTGGTCTGGGAAATGCTTCTTGTAC | SEQ ID NO: 739 | Homo sapiens chromatin modifying protein 5 (CHMP5), mRNA [NM_016410] |
| 740 | A_23_P83414 | PPP1CB | AAATAGCACATTGTCCAATCGAGTGATTTTAATCATACAGTTGACTGGGCAAGTTTA | SEQ ID NO: 740 | Homo sapiens protein phosphatase 1, catalytic subunit, beta isoform (PPP1CB), transcript variant 1, mRNA [NM_002709] |
| 741 | A_23_P86403 | KIF5B | AACAGAACTAGAGTGCAACATGGAATTTTGGCATCGTTAGGGAGGAAAAAGGACAGTTACAACTGTG | SEQ ID NO: 741 | Homo sapiens kinesin family member 5B (KIF5B), mRNA [NM_004521] |
| 742 | A_23_P86653 | SRGN | AGGGACTTGGGTCAACATGGATTAGAAGAGGATTTATGTTATAAAGAGGATATTTCCCAC | SEQ ID NO: 742 | Homo sapiens serglycin (SRGN), mRNA [NM_002727] |
| 743 | A_23_P92842 | SAR1B | TAATCTGACATCACCCACCCCAGCGCCATTTGTAAGAGCAACTTTCCAGCAGTACATTTGAAG | SEQ ID NO: 743 | Homo sapiens SAR1 gene homolog B (S. cerevisiae) (SAR1B), transcript variant 2, mRNA [NM_016103] |
| 744 | A_23_P94230 | LY96 | TGAAGGTATTTCTGGGAGGCCCAGAAGGAAAATGCTCTTTTGCTTGGAGTTGTTCATCGTACA | SEQ ID NO: 744 | Homo sapiens lymphocyte antigen 96 (LY96), mRNA [NM_015364] |
| 745 | A_23_P94533 | CTSL1 | AAGACATGGATCATGGTGTGTGCTGGTGTAAAGTGATTCGTATAGTCTCGCACAGAATCAGATA | SEQ ID NO: 745 | Homo sapiens cathepsin L1 (CTSL1), transcript variant 1, mRNA [NM_001912] |
| 746 | A_23_P94932 | C2orf25 | TCTGTTGATGACCTTGGATGCTGTGTAAAGTGATTCGTATAGTCTCTGGGGGTACCCATGTA | SEQ ID NO: 746 | Homo sapiens chromosome 2 open reading frame 25 (C2orf25), mRNA [NM_015702] |
| 747 | A_23_P95130 | SLC37A3 | TTGAGGAGTACGCTAATTCGATTCGATTCGGTTAGGGGATATTTTTCAACCTCTTGCTTTATACT | SEQ ID NO: 747 | Homo sapiens solute carrier family 37 (glycerol-3-phosphate transporter), member 3 (SLC37A3), transcript variant 1, mRNA [NM_207113] |
| 748 | A_23_P98382 | TIMM8B | TTGTTACTAAGGAGATTTAAGGGTCAGTGGGGGAAGGCTATCAACCCATTGTCAGATCAG | SEQ ID NO: 748 | Homo sapiens translocase of inner mitochondrial membrane 8 homolog B (yeast) (TIMM8B), mRNA [NM_012459] |

Fig. 1-42

| No. | Probe ID No. | Symbols of genes | Sequence | SEQ ID NO: | Descriptions of genes (letters and numbers within [ ] indicates GenBank accession No.) |
|---|---|---|---|---|---|
| 749 | A_24_P101959 | LOC392221 | GCTTCAGTCGAGGAAGTAATGGTGAGCCTGCAAAAGTTGACATCACTTACCAGCAGGATC | SEQ ID NO: 749 | PREDICTED: Homo sapiens similar to Coiled-coil-helix-coiled-helix domain-containing protein 2 (HCV NS2 trans-regulated protein) (NS2TP) (LOC392221), mRNA [XM_373252] |
| 750 | A_24_P103386 | ID1 | GTCTCGTCCTTCAAAACAGTCTTAATTAACTTTCATATATTAGGAGATTAAACTAGCAGAG | SEQ ID NO: 750 | Homo sapiens isopentenyl-diphosphate delta isomerase 1 (IDI1), mRNA [NM_004508] |
| 751 | A_24_P105164 | RP11-217H1.1 | GGAATAATGTGTGTGGCTGGTATTGGACTTGTTGTATTATTCTCAGTGGATGCTCTCT | SEQ ID NO: 751 | Homo sapiens implantation-associated protein (DKFZp564K142), mRNA [NM_032121] |
| 752 | A_24_P105648 | BX111927 | TTATAGAGATGCTTCAGTTCAAATAACAGTGCAGTAATTACCGTATATCTAAAAGACTGCC | SEQ ID NO: 752 | BX111927 Soares_multiple_sclerosis_2NbHMSP Homo sapiens cDNA clone IMAGp998G05619, mRNA sequence [BX111927] |
| 753 | A_24_P11045 | THC2785765 | CCACCAGAAAACGTACACCTGATTTCATGACAAATACGGTAGGCAACACAGTCGGAATAG | SEQ ID NO: 753 | COX7B_HUMAN (P24311) Cytochrome c oxidase polypeptide VIIb, mitochondrial precursor partial (78%) [THC2785765] |
| 754 | A_24_P110591 | A_24_P110591 | TGATGGAACTATAACAACAGAATCAGGAACTGTAATGAGGTCTCTTGGGCAGAATCCCAC | SEQ ID NO: 754 | |
| 755 | A_24_P111737 | ATP11B | GGTCGTCGTTCAAGTGGTTCTGTGGTTGGTTGCCATAATCCTGATGGTTGTTACATGTCTATT | SEQ ID NO: 755 | Homo sapiens ATPase, Class VI, type 11B (ATP11B), mRNA [NM_014616] |
| 756 | A_24_P114249 | GALNT3 | ATTTCAAATGCAGAATACTTGACTCATTTAAAGCTAAATTTGTTACTGATTCAATTATA | SEQ ID NO: 756 | Homo sapiens UDP-N-acetyl-alpha-D-galactosamine:polypeptide N-acetylgalactosaminyltransferase 3 (GalNAc-T3) (GALNT3), mRNA [NM_004482] |
| 757 | A_24_P114617 | CHMP2B | GCCTAATTGAAATATGTACTCTATTTTAGACACGCCTCTGTTAAAACAGACCAAGGTTT | SEQ ID NO: 757 | Homo sapiens chromatin modifying protein 2B (CHMP2B), mRNA [NM_014043] |
| 758 | A_24_P115774 | BIRC2 | GATACCATTTTGGTTAAAGGAAATGCGGCGGCCAACATGTCAAAAAGTGTCTAAAAGAA | SEQ ID NO: 758 | Homo sapiens baculoviral IAP repeat-containing 2 (BIRC2), mRNA [NM_001166] |
| 759 | A_24_P119141 | PROS1 | AGCAGCAGAGGAATCTTACTCTTGGCAGGTCAGTCTGTCAAGAATGAAGATCAGATTA | SEQ ID NO: 759 | Homo sapiens protein S (alpha) (PROS1), mRNA [NM_000313] |
| 760 | A_24_P12149 | CLINT1 | TTAACTTGGCAAGGCTTCGTTCGAGTGTTTATCCTGTAGGCATCATTTAAGTCAGGAACA | SEQ ID NO: 760 | Homo sapiens clathrin interactor 1 (CLINT1), mRNA [NM_014666] |
| 761 | A_24_P123052 | RAP2B | GGAATAAGTTCCTGCATTATAAGTATAAAGGGAACCGAGATTTAATTGAGAGCATCAC | SEQ ID NO: 761 | Homo sapiens RAP2B, member of RAS oncogene family (RAP2B), mRNA [NM_002886] |
| 762 | A_24_P124992 | PSMA4 | AAACGTCCCTTTGGTGTTTCATTGCTGTACATTGGCTGGGATAAGCACTATGGCTTTCAG | SEQ ID NO: 762 | Homo sapiens proteasome (prosome, macropain) subunit, alpha type, 4 (PSMA4), mRNA [NM_002789] |
| 763 | A_24_P125741 | ENST00000309178 | AGCCTCCAACCACACTAACAACAGAATTCAAGATTACTTGCAACAGCTGACAGGAGCAGAAT | SEQ ID NO: 763 | |
| 764 | A_24_P131392 | FAM82A | GTATGCCCTGGTTATTCTAATCCCAATTAGATGTAGTAGCAAAGTGTTATACTGATCTT | SEQ ID NO: 764 | Homo sapiens family with sequence similarity 82, member A (FAM82A), mRNA [NM_144713] |
| 765 | A_24_P137372 | ATP2C1 | TCCGGTTCAGAAGGTTTTCAGAGACTGAGAGCCTAAGGACATACTGGATCTGTTGTTTCTTTT | SEQ ID NO: 765 | Homo sapiens ATPase, Ca++ transporting, type 2C, member 1 (ATP2C1), transcript variant 2, mRNA [NM_001001487] |

Fig. 1-43

| No. | Probe ID No. | Symbols of genes | Sequence | SEQ ID NO: | Descriptions of genes (letters and numbers within [ ] indicates GenBank accession No.) |
|---|---|---|---|---|---|
| 766 | A_24_P140827 | PCMT1 | GGATGAATTGCTAAAAGCAACATCAGGTTGACCAGTATAAAATTAGAGTGGATTGCTCATC | SEQ ID NO: 766 | Homo sapiens protein-L-isoaspartate (D-aspartate) O-methyltransferase (PCMT1), mRNA [NM_005389] |
| 767 | A_24_P148670 | SLK | TGTTGGTTGCTGGTGTGTGTAATTATTAATGAAATGTTCAGTCCTAGTCCCTTATGAGGCT | SEQ ID NO: 767 | Homo sapiens STE20-like kinase (yeast) (SLK), mRNA [NM_014720] |
| 768 | A_24_P152385 | THC2736233 | CAAACAGGTCACACTGCAAGGAAGGTGTGTTGAATGTTTCAGAGGTCACTGGGGTGTGGAT | SEQ ID NO: 768 | ATP5L_PONPY (Q5RFH0) ATP synthase subunit g, mitochondrial (ATPase subunit g), partial (91%) [THC2736233] |
| 769 | A_24_P157415 | ATP11B | CTGTACTGTAACACAGGTGTAAAGTTAGGCATATAAATGCAAGGGTATATCATATATAC | SEQ ID NO: 769 | Homo sapiens ATPase, Class VI, type 11B (ATP11B), mRNA [NM_014616] |
| 770 | A_24_P169976 | LOC652912 | TTGTGTTCTGTTCTGAGTATCAGCCCAAAAACCAAGAGAAGAATCCTGTCAGTCCACTA | SEQ ID NO: 770 | PREDICTED: Homo sapiens similar to High mobility group protein B1 (High mobility group protein 1) (HMG-1) (Amphoterin) (Heparin-binding protein p30) (LOC652912), mRNA [XR_019552] |
| 771 | A_24_P175187 | SAMD9 | CAACCAGGCATAGTGTCTGAGTAATCAAAATGTAATTTTCGCCTAATAAATTATGGATATGGGCAAG | SEQ ID NO: 771 | Homo sapiens sterile alpha motif domain containing 9 (SAMD9), mRNA [NM_017654] |
| 772 | A_24_P175188 | SAMD9 | TGGCAATGTACTGGACAGATTAACATACAACCTATGTTGTTTGAACAAAACACCAAGGGATA | SEQ ID NO: 772 | Homo sapiens sterile alpha motif domain containing 9 (SAMD9), mRNA [NM_017654] |
| 773 | A_24_P175519 | TXN | AAGTAGATGTGGATGAGACTGTGCAGTATGTTGCTTCAGAGTGTGAAGTCAAATGCACGGCCAA | SEQ ID NO: 773 | Homo sapiens thioredoxin (TXN), mRNA [NM_003329] |
| 774 | A_24_P175989 | VPS29 | GAGAGGAGACTTCGGATGAGAATCTGAATTATCCAGACAGAAAAGTTGTGACTGTTGGACA | SEQ ID NO: 774 | Homo sapiens vacuolar protein sorting 29 homolog (S. cerevisiae) (VPS29), transcript variant 2, mRNA [NM_057180] |
| 775 | A_24_P177634 | A_24_P177634 | CATTCATTCAGGTCTCTGTATGGACCAGAACATCTGATAAATGAGTTCTTCTTTGGGGATCAA | SEQ ID NO: 775 | |
| 776 | A_24_P180424 | TMEM30A | CAATGTGTATGCAACATTCTGTTTAGTTAAGGCACCAATTGTTTTGGTTGGTTTTCGTAAG | SEQ ID NO: 776 | Homo sapiens transmembrane protein 30A (TMEM30A), mRNA [NM_018247] |
| 777 | A_24_P186862 | CHMP5 | TGAGAATTTACAAGACACCAGCTAGTGGACATGATGGAAGATGCAAATGAAATCCAAGAAGC | SEQ ID NO: 777 | Homo sapiens chromatin modifying protein 5 (CHMP5), mRNA [NM_016410] |
| 778 | A_24_P195327 | LOC391040 | ACAGCTTAACAATCCTTAAGAAGTTAGGTGAACAGTTCCATGGCAAGTCTTGGAGAGTA | SEQ ID NO: 778 | PREDICTED: Homo sapiens similar to basic transcription factor 3-like 4 (LOC391040), mRNA [XR_019253] |
| 779 | A_24_P200162 | HIGD1A | TATTCAGTGTATCGGGAATTCTGGGCAAAAACCTAAGGCTTAGAAGAAGATGCTGTGTT | SEQ ID NO: 779 | Homo sapiens HIG1 domain family, member 1A (HIGD1A), mRNA [NM_014056] |
| 780 | A_24_P201120 | KIAA1212 | TTGGACAATGAAAATGCCTTAAAAGGAATGCATATGGATAAAGTTGCACTTATAACACCC | SEQ ID NO: 780 | Homo sapiens KIAA1212 (KIAA1212), mRNA [NM_018084] |
| 781 | A_24_P201702 | CLEC2B | ATTGGAATTCAAGTAAATACAACTGTCCAGTCAACATGCCGACCTAACTATAATTGACA | SEQ ID NO: 781 | Homo sapiens C-type lectin domain family 2, member B (CLEC2B), mRNA [NM_005127] |
| 782 | A_24_P209204 | C6orf62 | GGTTGCATACTTTATTGGAGTAAATCTGAATGATCCTAGTCCTTTGGAGTAAGACTAGT | SEQ ID NO: 782 | Homo sapiens chromosome 6 open reading frame 62 (C6orf62), mRNA [NM_030939] |
| 783 | A_24_P211351 | ENST00000370395 | GTTGTGGATTCGTTCGATCAACTGCTGATTTCATCTTCAGGAAGCAAGTCCATAACATGA | SEQ ID NO: 783 | DPH3 homolog B (CSL-type zinc finger-containing protein 1). [Source:Uniprot/SWISSPROT;Acc:Q9H4G8] [ENST00000370395] |

Fig. 1-44

| No. | Probe ID No. | Symbols of genes | Sequence | SEQ ID NO: | Descriptions of genes (letters and numbers within [ ] indicates GenBank accession No.) |
|---|---|---|---|---|---|
| 784 | A_24_P216654 | SOAT1 | CGCAGTAATGTTCTGCACAACAGTATTGTAATTGTAATGGAATCATAACCTGCTAACTAG | SEQ ID NO: 784 | Homo sapiens sterol O-acyltransferase (acyl-Coenzyme A: cholesterol acyltransferase) 1 (SOAT1), transcript variant 1, mRNA [NM_003101] |
| 785 | A_24_P223124 | FNDC3B | CTCACTGTTGGACATACATTCCAAGGCTTTCAACTCTAGGAGAAAAAGAAAATCATGTTT | SEQ ID NO: 785 | Homo sapiens fibronectin type III domain containing 3B (FNDC3B), mRNA [NM_022763] |
| 786 | A_24_P23245 | NDUFA6 | TTCTGGTCATTTAAGGGAAAGATCGAACTGGAAGAAAACAATTAAAGTATGGAAGCAGGGGA | SEQ ID NO: 786 | Homo sapiens NADH dehydrogenase (ubiquinone) 1 alpha subcomplex, 6, 14kDa (NDUFA6), nuclear gene encoding mitochondrial protein, mRNA [NM_002490] |
| 787 | A_24_P234214 | HNRPLL | AGAGCTGTCACACACGTTAATAATGTCAAATTATTTGGGAAAAGACTTAATGTTTGCGTG | SEQ ID NO: 787 | Homo sapiens heterogeneous nuclear ribonucleoprotein L-like (HNRPLL), mRNA [NM_138394] |
| 788 | A_24_P240065 | VPS24 | CACCATGAGGGAGTTGTCCAAAGAAATGATGAAGGCTGGGATCATAGAGGAGAATGTTAGA | SEQ ID NO: 788 | Homo sapiens vacuolar protein sorting 24 homolog (S. cerevisiae) (VPS24), transcript variant 1, mRNA [NM_016079] |
| 789 | A_24_P247608 | PCMT1 | GTATGGTTGGATGTACTGGAAAATGCATAGGAATTGATCACATTAAAGAGCTAGTAGATG | SEQ ID NO: 789 | Homo sapiens protein-L-isoaspartate (D-aspartate) O-methyltransferase (PCMT1), mRNA [NM_005389] |
| 790 | A_24_P255314 | SRP14P1 | TATCGATGGGAAAAAGAAGAAGATGAGACTGTGTGAACTCCAAGGAAGTGAGTAAGTTTCA | SEQ ID NO: 790 | Homo sapiens signal recognition particle 14kDa (homologous Alu RNA binding protein) pseudogene 1 (SRP14P1) on chromosome 12 [NR_003273] |
| 791 | A_24_P263524 | TXNDC9 | TGAGTTCACCACAGAAAACTTTAGAATGGGGGCTCAGTGTTCTGTACATTCTTAATTACAG | SEQ ID NO: 791 | Homo sapiens thioredoxin domain containing 9 (TXNDC9), mRNA [NM_005783] |
| 792 | A_24_P278460 | MLSTD2 | ACCCATGGAAGCAATATGGTTAGGAATTACAGAGGAAGCAGTCCTTAGTTACACTTCTTGTCTG | SEQ ID NO: 792 | Homo sapiens male sterility domain containing 2 (MLSTD2), mRNA [NM_032228] |
| 793 | A_24_P283320 | PCMT1 | CAAAATGTAAGCCATACATGGATTGTCCACAATCAATAGGTTTCCAAGCAACAATCAGTG | SEQ ID NO: 793 | Homo sapiens protein-L-isoaspartate (D-aspartate) O-methyltransferase (PCMT1), mRNA [NM_005389] |
| 794 | A_24_P320284 | DHFR | CTCTCTGATGTCCAGGAGGAGAGGAAAGGGCATTAAGTACAAATTGAAGTATATGAGAGAAT | SEQ ID NO: 794 | Homo sapiens dihydrofolate reductase (DHFR), mRNA [NM_000791] |
| 795 | A_24_P320328 | SUB1 | CAGAAAAACGTGTAAAGAAAAACAAAAGACAGGTGAGACTTGGAGACTTCTCTA | SEQ ID NO: 795 | Homo sapiens SUB1 homolog (S. cerevisiae) (SUB1), mRNA [NM_006713] |
| 796 | A_24_P322353 | PSTPIP2 | AGAATCTTTCCCTTGCTCAGACCCCAGAATTTAAATGCATCCGTCTTACACTTTCACAAA | SEQ ID NO: 796 | Homo sapiens proline-serine-threonine phosphatase interacting protein 2 (PSTPIP2), mRNA [NM_024430] |
| 797 | A_24_P324506 | A_24_P324506 | GCAATATAAGGCAGCTAATTGCAAATACAAGTATGGCTATTCCTGTGGACATGCTGTGT | SEQ ID NO: 797 | |
| 798 | A_24_P324886 | DOCK4 | ATTTGCCTCTTTTGTTGGGAAGGTCATTTAGTTAACCATGTTTGTTTGTTGGTAGC | SEQ ID NO: 798 | Homo sapiens dedicator of cytokinesis 4 (DOCK4), mRNA [NM_014705] |
| 799 | A_24_P325176 | KIAA1109 | TTGATCGAGTAGGTGTTGATTATATTCTTGAAAAATTGGGGCTTTGATCATGCTAGGAGTA | SEQ ID NO: 799 | Homo sapiens KIAA1109, mRNA (cDNA clone IMAGE:3924668), complete cds, [BC108274] |
| 800 | A_24_P32766 | LOC730556 | ACAGCAGCAGCAGCCTTGCTTCTTCATGAGCAGTGTGCTGGAGTGTGCCGAGAACCAGGGTGA | SEQ ID NO: 800 | PREDICTED: Homo sapiens similar to Coiled-coil helix-coiled-coil-helix domain-containing protein 2 (HCV NS2 trans-regulated protein) (NS2TP) (LOC730556), mRNA [XR_015322] |

Fig. 1-45

| No. | Probe ID No. | Symbols of genes | Sequence | SEQ ID NO: | Descriptions of genes (letters and numbers within [ ] indicates GenBank accession No.) |
|---|---|---|---|---|---|
| 801 | A_24_P351451 | OPA1 | TTTTTGGGTATACAGGCGCATGCTTGGTATCACCGGCAAATACTTTAAGGCAACAAGTTACA | SEQ ID NO: 801 | Homo sapiens optic atrophy 1 (autosomal dominant) (OPA1), nuclear gene encoding mitochondrial protein, transcript variant 8, mRNA [NM_130837] |
| 802 | A_24_P355601 | HEXIM1 | GATGAACCCATGAAATTATTGTAGAGTTGTATGTACATTTTCTGGGGAGAAGGTTGA | SEQ ID NO: 802 | Homo sapiens hexamethylene bis-acetamide inducible 1 (HEXIM1), mRNA [NM_006460] |
| 803 | A_24_P362540 | DDEF2 | TGGTGCTATTGTGCAGTAACTAATAGTAGTACTTACCAGAGGAGAAATTATATTAACGACC | SEQ ID NO: 803 | Homo sapiens development and differentiation enhancing factor 2 (DDEF2), mRNA [NM_003887] |
| 804 | A_24_P362646 | TXNDC9 | CTCCAGATTCAGGTGTAAAATAGTAGACAGACATCTGGCAATATTGTCGAAGAAACACCT | SEQ ID NO: 804 | Homo sapiens thioredoxin domain containing 9 (TXNDC9), mRNA [NM_005783] |
| 805 | A_24_P379379 | CAP2A1 | ACCAGTTTCAGGCTAAAAACTTGTGGAATGGTCGTTGGAGATACAGAGTGAAGTTCACCA | SEQ ID NO: 805 | Homo sapiens capping protein (actin filament) muscle Z-line, alpha 1 (CAPZA1), mRNA [NM_006135] |
| 806 | A_24_P388810 | SRP19 | GTTGTATGCAGCAGAAATGATACCTAAACTAAAACAAGGACAAAAACAGGAGGTGC | SEQ ID NO: 806 | Homo sapiens signal recognition particle 19kDa (SRP19), mRNA [NM_003135] |
| 807 | A_24_P39378 | CCPG1 | TACTTTTTGTGGGTGGGAAGGAAGTTGATCAGTTGATCAATAAGTTTTTCCTAAACGGTGT | SEQ ID NO: 807 | Homo sapiens cell cycle progression 1 (CCPG1), transcript variant 1, mRNA [NM_004748] |
| 808 | A_24_P400760 | LOC643454 | TCCATGTAGACAAGGTCACAGTATTCTTGCAGAAATAATGGGGGAATGGTATTGGAGA | SEQ ID NO: 808 | PREDICTED: Homo sapiens similar to AP-3 complex subunit sigma-1 (Adapter-related protein complex 3 sigma-1 subunit) (Sigma-adaptin 3a) (AP-3 complex sigma-3A subunit) (Sigma-3A-adaptin) (LOC643454), mRNA [XR_016772] |
| 809 | A_24_P405298 | PPP1CB | GTATTAGGTTAGGTCACAAAGGTTTTATCTGAGGTGATTAAATAACTTCCTGATTGGAG | SEQ ID NO: 809 | Homo sapiens protein phosphatase 1, catalytic subunit, beta isoform (PPP1CB), transcript variant 1, mRNA [NM_002709] |
| 810 | A_24_P409410 |  | ACCAGGTAATATATGGATGCTTGGCTCTGGAGAAAAAGCTGGTATCAAGGTGCC | SEQ ID NO: 810 |  |
| 811 | A_24_P414256 | CCDC72 | TCTTTGGTCGTTGTTCTCAGGGTAAACTTGTATCACCGTGAATTAAGCCAAGTCATTTGA | SEQ ID NO: 811 | Homo sapiens HSPC330 mRNA, partial cds. [AF161448] |
| 812 | A_24_P417281 | TXNDC10 | ATGATGAGTGATTCTTGGGAAGGATAAATGTTAATGTTGCCAATAGTCAAGCTGTTGTTTGC | SEQ ID NO: 812 | Homo sapiens thioredoxin domain containing 10 (TXNDC10), mRNA [NM_019022] |
| 813 | A_24_P50753 | NUDT4 | AACAGAAAATAAGTAGTTTTTGTGAATGACTTGCAGACAAAGTAGAAACTGTGCTGCATG | SEQ ID NO: 813 | Homo sapiens nudix (nucleoside diphosphate linked moiety X)-type motif 4 (NUDT4), transcript variant 2, mRNA [NM_199040] |
| 814 | A_24_P53080 | ETFA | TGCTGTTGATGCTGGCTTTGTTCCCAATGACATGCAAGTTGGACAGACGGGAAAAATAGT | SEQ ID NO: 814 | Homo sapiens electron-transfer-flavoprotein, alpha polypeptide (glutaric aciduria II) (ETFA), nuclear gene encoding mitochondrial protein, mRNA [NM_000126] |
| 815 | A_24_P548415 | BC092452 | TATTTGTATGGTAAATCCTTGCAAACATGGAAACAATGCATTTGGCCCAGTGCTTTGTGG | SEQ ID NO: 815 | Homo sapiens cDNA clone IMAGE:30325817. [BC092452] |
| 816 | A_24_P561223 | THC2697551 | TTATGCCCAGTTACATACAAGGATCGTGCCATATTTCAGGGACCCTAAAGTTTATTAAGAT | SEQ ID NO: 816 | ALU1_HUMAN (P39188) Alu subfamily J sequence contamination warning entry, partial (8%) [THC2697551] |

Fig. 1-46

| No. | Probe ID No. | Symbols of genes | Sequence | SEQ ID NO: | Descriptions of genes (letters and numbers within [ ] indicate GenBank accession No.) |
|---|---|---|---|---|---|
| 817 | A_24_P56130 | MYL6 | CCAAGAGAGTGATGAGATGAATGTGAAGGTGGTGCTTTGAGGACTTTCTGCCCATGCTGC | SEQ ID NO: 817 | Homo sapiens myosin, light chain 6, alkali, smooth muscle and non-muscle (MYL6), transcript variant 2, mRNA [NM_079423] |
| 818 | A_24_P587882 |  | CTGGAAATGGTGTGTATTAGCACTGAGAAGACAGAAATCCATTCTGTATGATGAAGCA | SEQ ID NO: 818 |  |
| 819 | A_24_P675386 | BX109843 | ACGTGAAATGCACTTTAAATGTTTGCCTTATATCCAAGTGTTACTTGATATCCATGACG | SEQ ID NO: 819 | BX109843 Soares placenta Nb2HP Homo sapiens cDNA clone IMAGp998I14208, mRNA sequence [BX109843] |
| 820 | A_24_P684186 | U52054 | GCTTGACTAACCCCAGAATTATCTTCAAGACTTAATCTGATCTTGTGTCTTAGAGAAGC | SEQ ID NO: 820 | Human S6 H-8 mRNA expressed in chromosome 6-suppressed melanoma cells. [U52054] |
| 821 | A_24_P703614 |  | AAGAACATTACCGGAATGGAGTCTGCACTGTAAGTCATCAGTAGCAGCTTTGTGTGTG | SEQ ID NO: 821 |  |
| 822 | A_24_P724640 | SNRPB2 | ATCCTCAGGTCCTCGATTACCCTCCAAACTATATTTATTCTTAATAACTTACGACAGAAG | SEQ ID NO: 822 | Homo sapiens small nuclear ribonucleoprotein polypeptide B" (SNRPB2), transcript variant 1, mRNA [NM_003092] |
| 823 | A_24_P745670 |  | GGTAAAACAGAGACATGAATACATTTCCAACTCAAATTTGAAGATCCCAAATCTGAAGTC | SEQ ID NO: 823 |  |
| 824 | A_24_P787947 | YPEL2 | AAGGTAAAGCCTAGAACATGAAAACTATCATGAAAGCTATTCTCATGTTACCAAATTCTATCTGGGC | SEQ ID NO: 824 | Homo sapiens yippee-like 2 (Drosophila) (YPEL2), mRNA [NM_001005404] |
| 825 | A_24_P79413 | SEC11A | GTTTTCGTTACTGGATGTTTGGAGTAGATACTGGTCTGTGATTGGTGGAATGGAGAGAC | SEQ ID NO: 825 | Homo sapiens SEC11 homolog A (S. cerevisiae) (SEC11A), mRNA [NM_014300] |
| 826 | A_24_P81965 | RAP2A | TTCTTTTGATGTTGCAACTTTTGGGTTCTTTTAAACGTGTGATAGTGATGGTAACGTAGC | SEQ ID NO: 826 | Homo sapiens RAP2A, member of RAS oncogene family (RAP2A), mRNA [NM_021033] |
| 827 | A_24_P859859 | THC2553238 | TTTAACGAGACGTCTGCACCTTTTCTGCCTGATATACTGAGGACACTCGGTCTCTAGGCAAT | SEQ ID NO: 827 | 13D5349A cystic fibrosis antigen. [Homo sapiens] (exp=-1; wgp=0; cg=0), partial (65%) [THC2553238] |
| 828 | A_24_P879563 | LOC220906 | TGTAGTTGCAAGGAAAAAATTCCCAGAGTTTTCTGCATTCGGTGCTGGGTCATCTGAAAT | SEQ ID NO: 828 | Homo sapiens hypothetical protein LOC220906, mRNA (cDNA clone IMAGE:4837455). [BC045818] |
| 829 | A_24_P920181 | YIPF6 | AAGTCTTAAAAGTCAACCGTTAATCATTAAGTCTTTGCCTCTCAAAGTCTTTGCCTCTG | SEQ ID NO: 829 | Protein YIPF6 (YIP1 family member 6). [Source:Uniprot/SWISSPROT:Acc:Q86EC3] [ENST00000374643] |
| 830 | A_24_P941699 | PCGF5 | TGGTATATTCAACTACAGACTTCTAAGGATAGGACTACTTTCATGTCTAGTAATACACTG | SEQ ID NO: 830 | Homo sapiens polycomb group ring finger 5 (PCGF5), mRNA [NM_032373] |
| 831 | A_24_P95029 | TAX1BP1 | TGGTTGATTCGAGCTTTGATGTTCACAAGAAGTGTCGCCCTCTGTGAGTTAATGTTTCCT | SEQ ID NO: 831 | Homo sapiens Tax1 (human T-cell leukemia virus type I) binding protein 1 (TAX1BP1), transcript variant 1, mRNA [NM_006024] |
| 832 | A_24_P100338 | THC2586959 | AATTAGAGAAACATTCTGTGTGTTTGATAAGGATGGAATGGGTATATTAGTGGTGTAGA | SEQ ID NO: 832 | 1PK0_D Chain D, Crystal Structure Of The Ef3-Gam Complexed With Pmeapp. [Homo sapiens] (exp=-0; cg=0), partial (70%) [THC2586959] |
| 833 | A_32_P10100 | A_32_P10100 | TATGAGGAAATAGTATCATGATTAGAAGCGTTGGAATGAGTATAAATAATGGCTGGTC | SEQ ID NO: 833 |  |
| 834 | A_32_P10424 | AX721252 | AAATTTGTCAGGAAGGAAGGAATGGGAACGTCTAGATGTGCACAACTGATACCAGGGCTCAACAA | SEQ ID NO: 834 | Sequence 212 from Patent WO0220754. [AX721252] |

Fig. 1-47

| No. | Probe ID No. | Symbols of genes | Sequence | SEQ ID NO: | Descriptions of genes (letters and numbers within [ ] indicates GenBank accession No.) |
|---|---|---|---|---|---|
| 835 | A_32_P131377 | REEP5 | CATCACTAAAGCAAGAAGGGAAGAAAAGCTACGGTGAATTTACTGGGTGAAGAAAGAAGAGCAG | SEQ ID NO: 835 | Homo sapiens receptor accessory protein 5 (REEP5), mRNA [NM_005669] |
| 836 | A_32_P135402 | THOC7 | AGCTGGAATTGAGACGGAAACAGTTCATGTCTTCTTAGTACCATCCATGAACTCAGC | SEQ ID NO: 836 | Homo sapiens THO complex 7 homolog (Drosophila) (THOC7), mRNA [NM_025075] |
| 837 | A_32_P143323 | CR613267 | AGAGAGCTCAAACAATGGGGTTTATGCCAGTTACATACAAGGATCGTGCATATTTCAGGG | SEQ ID NO: 837 | full-length cDNA clone CS0DL011YP14 of B cells (Ramos cell line) Cot 25-normalized of Homo sapiens (human) [CR613267] |
| 838 | A_32_P147603 | THC2499508 | GCGTTGACTCGGACGGAGAAAATATCTAAAAATTCCGACGGGTCGGCGGTAGGGGTCCTGTGGTTT | SEQ ID NO: 838 | |
| 839 | A_32_P147747 | THC2575761 | TTGATACCCTCTGATTCTGATGACAAACGCCAATTTGGGTTCTGCAGGTACATAGAAGTTG | SEQ ID NO: 839 | HUMRPL7Y ribosomal protein L7 [Homo sapiens] (exp=-1; wgp=0; cg=0), partial (40%) [THC2575761] |
| 840 | A_32_P154830 | OSTM1 | GTTGGTAAATGTTACTTATATTGGGACTAGTAGTATTTTGTAAATGTTCTGGGATATGCTCCC | SEQ ID NO: 840 | Homo sapiens osteopetrosis associated transmembrane protein 1 (OSTM1), mRNA [NM_014028] |
| 841 | A_32_P159651 | PCAF | GAGTGGTGTCTAGATTTGTAATGAAGAATCATGATACAGTTTGGATTAAGTATCTTGGAC | SEQ ID NO: 841 | Homo sapiens p300/CBP-associated factor (PCAF), mRNA [NM_003884] |
| 842 | A_32_P161432 | CBWD2 | GAAAGAGAAACGTGATGGCCTTATCAATGAAGCTACTAGAACAAGTTGGCTTGGCAGATGCC | SEQ ID NO: 842 | Homo sapiens COBW domain containing 2 (CBWD2), mRNA [NM_172003] |
| 843 | A_32_P162250 | ARHGAP18 | AAGTCCTGAATAAGTCTACTGGAAGAATTATTCTTCGGGTGAAAAAGCTTTTTGTTGTG | SEQ ID NO: 843 | Homo sapiens Rho GTPase activating protein 18 (ARHGAP18), mRNA [NM_033515] |
| 844 | A_32_P162416 | BE218351 | GTCTATTTCAAATTCAGGTGTCCACTAGGTCAGGTTTAGAGGAGATGGTCTTTTAACAT | SEQ ID NO: 844 | hv37e08.x1 NCI_CGAP_Lu24 Homo sapiens cDNA clone IMAGE:3175622 3', mRNA sequence [BE218351] |
| 845 | A_32_P165713 | CIP29 | AAAGCAAGATCTTATCACAGACTCCAGGCATATCTGAAGAACATGCTGAAGAGGAGGC | SEQ ID NO: 845 | Homo sapiens cytokine induced protein 29 kDa (CIP29), mRNA [NM_033082] |
| 846 | A_32_P17163 | ENST00000368149 | TCGTTAGTGAGTTTTAAATCTCAAGCTAGAATTTTTATTGTTTTCTGTGTGTGTATGAG | SEQ ID NO: 846 | Rho GTPase-activating protein 18 (MacGAP). [Source:Uniprot/SWISSPROT;Acc:Q8N392] [ENST00000368149] |
| 847 | A_32_P17504 | THC2698882 | ATGTCTATGCTGTTTCAGTATGCTGCAAATATTCCCAGCTTTTCCCCTGATGCCCAAA | SEQ ID NO: 847 | |
| 848 | A_32_P195387 | DKFZP779L1068 | ATATAACCTTGGAATTCATTCTAATTATGTTGTTCTGGCTGCTTGTAGTATCAGTTCGC | SEQ ID NO: 848 | Homo sapiens cDNA clone IMAGE:5555490. [BC110326] |
| 849 | A_32_P200724 | FAM19A2 | AGAACAAAGTAATTTCTGAAGGAAGCTGAGAATATGGAAAACATATATTGGAGCTAC | SEQ ID NO: 849 | Homo sapiens mRNA; cDNA DKFZp781P0552 (from clone DKFZp781P0552). [CR749367] |
| 850 | A_32_P205550 | RPL26L1 | AGGTAGTTCGAGGACACATACAAAAGGTCAGGAAATTGGAAAGGTAATCCAGGTGTACAGAA | SEQ ID NO: 850 | Homo sapiens ribosomal protein L26-like 1 (RPL26L1), mRNA [NM_016093] |
| 851 | A_32_P205553 | RPL26L1 | TTCGGAATGTCTGGAACATTTGATTTCCTGTTTGTTACCTGTGGCTCTGTAAATGTACT | SEQ ID NO: 851 | Homo sapiens ribosomal protein L26-like 1 (RPL26L1), mRNA [NM_016093] |
| 852 | A_32_P206541 | LOC642123 | TTAAGAAGGCCCCATACCTGGTAGAGGCATGTACCATCTTACATGCTTAAATAACTCCAC | SEQ ID NO: 852 | Homo sapiens cDNA FLJ46881 fis, clone UTERU3015647, moderately similar to Embigin precursor. [AK128714] |
| 853 | A_32_P207231 | AI630435 | TTCTTCAGCTTTTCTTAAGGGTTTCTGGAACAGAGAGGAACCTCCTTCTTCTTCTTCT | SEQ ID NO: 853 | AI630435 ad10b05.y1 Hembase: Erythroid Progenitor Cells (LCB:ad library) Homo sapiens cDNA clone ad10b05 random, mRNA sequence [AI630435] |

Fig. 1-48

| No. | Probe ID No. | Symbols of genes | Sequence | SEQ ID NO: | Descriptions of genes (letters and numbers within [ ] indicates GenBank accession No.) |
|---|---|---|---|---|---|
| 854 | A_32_P223189 | SUMO1P3 | GAATGGAGGAAGAAGATGTGATTGAGGTTTATCAGGAACAAATCGGAGGTCATTCAACAG | SEQ ID NO: 854 | Homo sapiens SUMO1 pseudogene 3 (SUMO1P3) on chromosome 1 [NR_002190] |
| 855 | A_32_P224666 | CAPZA2 | AATGTGTTTTGAGATTCTGAAATTAAATGAAAATAGTTATTTCACAAATGCATTTAATG | SEQ ID NO: 855 | Homo sapiens capping protein (actin filament) muscle Z-line, alpha 2 (CAPZA2), mRNA [NM_006136] |
| 856 | A_32_P2333 | SUB1 | AGGAAGAAAAGGTATTTCTTTAAATCGAGAACAATGGAGCCAGCTGACAGAACAGATTTC | SEQ ID NO: 856 | Homo sapiens SUB1 homolog (S. cerevisiae) (SUB1), mRNA [NM_006713] |
| 857 | A_32_P26895 | KIAA1600 | AATTCTTGGTCCCTCCGTCGGTGGAGAAACTCTTCAGATGGTCATTGTGTACGTACTCTCTT | SEQ ID NO: 857 | KIAA1600 (KIAA1600), mRNA [Source:RefSeq_dna;Acc:NM_020940] [ENST00000369248] |
| 858 | A_32_P30004 | AF086044 | ATTTCTCTTTCTAAAGGGGAGTAAGTTTTTAAAGGCTTCCTGATTTTAGCCTGGCAATGT | SEQ ID NO: 858 | Homo sapiens full length insert cDNA clone YX74DC5. [AF086044] |
| 859 | A_32_P32250 | C10orf84 | CAAAAAGGAGGTTGAAAATTCACAGGCTGCCCGAAAAAAGAAGAAACTTGCATGGGGGTT | SEQ ID NO: 859 | Homo sapiens chromosome 10 open reading frame 84 (C10orf84), mRNA [NM_022063] |
| 860 | A_32_P32315 | A_32_P32315 | AAAGTGGGAAGATACGATTCAAGTCCTGGATTCTCGTCTTTGGAAAAAGGTCAGTCCTCA | SEQ ID NO: 860 | |
| 861 | A_32_P43217 | PSMA6 | TTGTTGTTAGTTTACCAGATCCGTGATGCCACTTACGTCTGTGTTTGGGTAACAAGAAACA | SEQ ID NO: 861 | Homo sapiens proteasome (prosome, macropain) subunit, alpha type, 6 (PSMA6), mRNA [NM_002791] |
| 862 | A_32_P44394 | AIM2 | GAAGAGATAAGGTTCGACTTACATTCTTCAGACTGTCAAAAATGGAGAAAAAGTTACAG | SEQ ID NO: 862 | Homo sapiens absent in melanoma 2 (AIM2), mRNA [NM_004833] |
| 863 | A_32_P62342 | GLT8D3 | TGTGATGTAACTGATGTAACCATTGAGAATCTATATGTGCGTTTATACATTCATCTCTG | SEQ ID NO: 863 | Homo sapiens glycosyltransferase 8 domain containing 3, mRNA (cDNA clone MGC:21651 IMAGE:4508300), complete cds. [BC039145] |
| 864 | A_32_P73222 | AA631847 | TTTCTTGTTTTGGACAATCTCATAAGAACTTTAGGTCTTACAGCACGAACCCGTCGAAG | SEQ ID NO: 864 | np6ib02.s1 NCI_CGAP_Br2 Homo sapiens cDNA clone IMAGE:1130763 3' similar to TR:G971838 G971838 60S RIBOSOMAL PROTEIN L34 ;, mRNA sequence [AA631847] |
| 865 | A_32_P81768 | TMEM167 | CCTCAGTACTGTCACTCACAATATTACATTCTGGAAATGTTATTCTGTTGTATCAGATACG | SEQ ID NO: 865 | Homo sapiens transmembrane protein 167 (TMEM167), mRNA [NM_174909] |
| 866 | A_32_P82424 | LOC647252 | ATTGGATGCTGAGCTAGTGAACTATAAGGACCAGATCAAGATGAGAGGGGGTCCTACAAA | SEQ ID NO: 866 | PREDICTED: Homo sapiens similar to Charged multivesicular body protein 5 (Chromatin-modifying protein 5) (Vacuolar protein sorting 60) (Vps60) (hVps60) (SNF7 domain-containing protein 2) (LOC647252), mRNA [XR_019210] |
| 867 | A_32_P89730 | THC2544977 | GGAGAATAAGTCATTCTGGTCTCTGTTTCCCGTTTTCCAGATAAAAGTATATTTGTCTTG | SEQ ID NO: 867 | |
| 868 | A_32_P95397 | ITGB1 | GTCTTACTTTGAGTTAGTTAGTGCCATAACAGAGACCACTGTATGTGTTTACTTCTGACCATTTGAGT | SEQ ID NO: 868 | Homo sapiens integrin, beta 1 (fibronectin receptor, beta polypeptide, antigen CD29 includes MDF2, MSK12) (ITGB1), transcript variant 1A, mRNA [NM_002211] |

Fig. 2

| No. | Probe ID No. | Symbols of genes | Sequence | SEQ ID NO: | Descriptions of genes (letters and numbers within [ ] indicate GenBank accession No.) |
|---|---|---|---|---|---|
| 1 | A_23_P407601 | C8orf6 | GTGTCCTAGGTTAGTGTAGGCAGAGATTCTATTGTGAGATAAGACTTCCGTGTCGGCTGAA | SEQ ID NO: 220 | Homo sapiens mRNA for hypothetical protein (C8orf6 gene), [AJ3074691] |
| 2 | A_32_P209582 | THC2663167 | CAATGTAAAGGCAGAATATGAAGGTCCTTTGTCAAGATTTTGAAACCTATTTGGCTGAT | SEQ ID NO: 506 | ALU1_HUMAN (P39188) Alu subfamily J sequence contamination warning entry, partial (5%) [THC2663167] |
| 3 | A_32_P213509 | THC2663555 | GATTTGTTCCAGTGTTGGAGGCGTTTTAATGAAAATTCTCAACACCTACACTGGAAAAA | SEQ ID NO: 508 | |
| 4 | A_32_P40673 | A_32_P40673 | CATCACAGTTGATATTAGGACAGGCTAGCTACTGTTGAGTGTCACAGGCTGATATGTA | SEQ ID NO: 523 | |
| 5 | A_32_P71171 | A_32_P71171 | TCTAGATAGTAATAGGAAACAAGAATCCAGCCTGGTGATGGCTGGAGGGAAGTGATTGAA | SEQ ID NO: 538 | |
| 6 | A_32_P98940 | THC2745859 | AAGAGTATTCCGAAGATAGGAAAGGTGTGTGTTGTTTTAGGAGGTGTATTTCAGCTAGTTA | SEQ ID NO: 554 | |
| 7 | A_23_P123608 | JAK2 | GGATAACGATGGCTGGATGAAAGAATGACCTTCATTCTGAGACCAAAGTAGATTTTACAGA | SEQ ID NO: 570 | Homo sapiens Janus kinase 2 (a protein tyrosine kinase) (JAK2), mRNA [NM_004972] |
| 8 | A_23_P138507 | CDC2 | CCCATGTCAAAAACTTGGATGAAAATGGGTTGGATTTGGTCTCGAAAATGTTAATGTATG | SEQ ID NO: 589 | Homo sapiens cell division cycle 2, G1 to S and G2 to M (CDC2), transcript variant 1, mRNA [NM_001786] |
| 9 | A_23_P14734 | RPS27L | TACAAGATCACCACGGTTTTCAGCGATGGTCAGACAGTGGTCTTTGTGTAGGTGTTCA | SEQ ID NO: 597 | Homo sapiens ribosomal protein S27-like (RPS27L), mRNA [NM_015920] |
| 10 | A_23_P152002 | BCL2A1 | GTTAACCATATTTTGGCATTTGAAGGTTATTCATCAAGAAAACTTCTACGACAGCAAATTGC | SEQ ID NO: 602 | Homo sapiens BCL2-related protein A1 (BCL2A1), mRNA [NM_004049] |
| 11 | A_23_P18325 | PDCD10 | CCAACCCACTAATTCATCAAAGCAAGCTAATACTTCAGACCTTCAAAACTGTGGCCTGA | SEQ ID NO: 618 | Homo sapiens programmed cell death 10 (PDCD10), transcript variant 1, mRNA [NM_007217] |
| 12 | A_23_P2705 | P2RY5 | TCTGTATTGCTGTTTCAACTGTTGTTTTGACCCTATAGTTACTAGTTTACATGGAGCA | SEQ ID NO: 654 | Homo sapiens purinergic receptor P2Y, G-protein coupled, 5 (P2RY5), mRNA [NM_005767] |
| 13 | A_23_P41114 | CSTA | AAAGATGAGATTATGGAAAATTGGAAGGTGTGCAGTAGTATAAACTCAAGTTGTTGCTG | SEQ ID NO: 689 | Homo sapiens cystatin A (stefin A) (CSTA), mRNA [NM_005213] |
| 14 | A_23_P424809 | S100A8 | AAAGGCATGAAGAAAGGACAATGGGTAGATGGAGCTAGCATTTACCAAATCAGAGGCTGGGCCCT | SEQ ID NO: 701 | Homo sapiens S100 calcium binding protein A8 (S100A8), mRNA [NM_002964] |
| 15 | A_23_P76480 | BF213738 | AATCAACAGGAGACGAATGGGTAGATGGAGCTACGATTTACCAAATCGTTGGCATGACAGG | SEQ ID NO: 726 | BF213738 601847628F1 NIH_MGC_55 Homo sapiens cDNA clone IMAGE:4078519 5', mRNA sequence [BF213738] |
| 16 | A_23_P94230 | LY96 | TGAAGTATATTCTGGGAGCCCAGAAGAAAATGCTCTTTGTTGGAGTTTGTCATCCTACA | SEQ ID NO: 744 | Homo sapiens lymphocyte antigen 96 (LY96), mRNA [NM_015364] |
| 17 | A_24_P124992 | PSMA4 | AAACGTCCCTTTGGTGTTTCATTGCTGTACATTGGCTGGGATAAGCACTATGGCTTTCAG | SEQ ID NO: 762 | Homo sapiens proteasome (prosome, macropain) subunit, alpha type, 4 (PSMA4), mRNA [NM_002789] |
| 18 | A_24_P126741 | ENST00000309178 | AGCCTCCAACCACGACTAACAAGATTCAAGATTAGTTGCAACAGGTCACAGAGCGAGAAT | SEQ ID NO: 763 | |
| 19 | A_24_P201702 | CLEC2B | ATTGGAATTCAAGTAAATAAATGTCACTCAACATGCCACTGCGACCTAACTATAATTGACA | SEQ ID NO: 781 | Homo sapiens C-type lectin domain family 2, member B (CLEC2B), mRNA [NM_005127] |
| 20 | A_24_P320328 | SUB1 | CAGAAAAACCTGTAAAGAACAAAAGACAGGTGAGACTTCGAGAGCCCTGTCATCTTCTA | SEQ ID NO: 795 | Homo sapiens SUB1 homolog (S. cerevisiae) (SUB1), mRNA [NM_006713] |
| 21 | A_32_P200724 | FAM9A2 | AGAACAAAGTAATTTTCTGAAGGGAAGCTGCAGAATATGGAAAACATATATTGGAGGTAC | SEQ ID NO: 849 | Homo sapiens mRNA; cDNA DKFZp781P0552 (from clone DKFZp781P0552), [CR749367] |

Fig. 3-1

| No. | Probe ID No. | Symbols of genes | Sequence | SEQ ID NO: | Descriptions of genes (letters and numbers within [ ] indicates GenBank accession No.) |
|---|---|---|---|---|---|
| 1 | A_23_P12343 | GSTM3 | AGCTTGTTTTGTTTCATCCTCTCCGTAAGGGGTCAGCGCTGTTGG TTTGCTCTTTTCAAT | SEQ ID NO: 869 | Homo sapiens glutathione S-transferase M3 (brain) (GSTM3), mRNA [NM_000849] |
| 2 | A_23_P143247 | TSHZ2 | CCCACAAGACGGTATGCAAATCTCTAAGTTTACGGGACTCTCAAT GACCACTACAGTCA | SEQ ID NO: 870 | Homo sapiens teashirt family zinc finger 2 (TSHZ2), mRNA [NM_173485] |
| 3 | A_23_P146325 | DDEF1IT1 | TGGAAAGTGAAGTGAAGGATTTTGTCATACAGCCAGTAAGTGCC AGAACTGACTTGAAC | SEQ ID NO: 871 | Homo sapiens DDEF1 intronic transcript 1 (DDEF1IT1) on chromosome 8 [NR_002765] |
| 4 | A_23_P14853 | LTK | AGCTTTGATCTTGGGGCCAGAGGCGGCCTTACACACACCCCAGG TGTGCATGGGGAGCA | SEQ ID NO: 872 | Homo sapiens leukocyte tyrosine kinase (LTK), transcript variant 1, mRNA [NM_002344] |
| 5 | A_23_P20666 | TPM2 | GGAGTATTCCACCAAAGAAGAATAAATATGAAGAGGAAGATGAAACT GTTGGAGGAGAAGCT | SEQ ID NO: 873 | Homo sapiens tropomyosin 2 (beta) (TPM2), transcript variant 2, mRNA [NM_213674] |
| 6 | A_23_P315378 | ATG16L1 | CTGTGTTTCCAGTTTATACTCTTTGTCCAAAACTCAGTTTCAAAA TATTTGCAATGGGAC | SEQ ID NO: 874 | Homo sapiens cDNA FLJ10035 fis, clone HEMBA1000919. [AK000997] |
| 7 | A_23_P339095 | SPTBN1 | AGTAGGGATACTTCAAAAGGACAACAGTTTCCAAAACGGTTTGC CAGCTGAACAGGGAT | SEQ ID NO: 875 | Homo sapiens spectrin, beta, non-erythrocytic 1 (SPTBN1), transcript variant 2, mRNA [NM_178313] |
| 8 | A_23_P344531 | SYNPO | TCCTGCTGCTGTGAAGATGAGAAGGTGCTCTTACTCAGTTAATGA TGAGTGACTATATTT | SEQ ID NO: 876 | Synaptopodin. [Source:Uniprot/SWISSPROT;Acc:Q8N3V7] [ENST00000307662] |
| 9 | A_23_P359174 | BC069659 | CCAGGGGTGCATACTACTAGGGTAAAGAACAAAATTTTGTAATAGCAAACA GTGGTTTGGGATTTT | SEQ ID NO: 877 | Homo sapiens cDNA clone IMAGE:7262526, with apparent retained intron. [BC069659] |
| 10 | A_23_P359870 | C8orf6 | CTGAGGTTATAATTTTCAGTTAACATTGTCGAGTTGGCATTTTGG TTTTAGTGAATGGT | SEQ ID NO: 878 | Homo sapiens mRNA for hypothetical protein (C8ORF16). [AJ312026] |
| 11 | A_23_P379147 | KRT74 | ATGTCTGCTGAGAATGCATGCTGTGTGAGGATCTCTGTCATCAGC AGTAGGAGGTACAGC | SEQ ID NO: 879 | Homo sapiens keratin 74 (KRT74), mRNA [NM_175053] |
| 12 | A_23_P3921 | FLJ11710 | CCTGATTCATGATTGAAGTACCATTAGGCTATACCATAAATGCC ATGCATTGGATGTTA | SEQ ID NO: 880 | Homo sapiens cDNA FLJ11710 fis, clone HEMBA1005149. [AK021772] |
| 13 | A_23_P407601 | C8orf6 | GTCTCGTAGGTTAGGTGTAGGAGAGATTCTATTCTCAGATAAGACT TCCGTGTCGGCTGAA | SEQ ID NO: 881 | Homo sapiens mRNA for hypothetical protein (C8orf6 gene). [AJ307469] |
| 14 | A_23_P88222 | PLD4 | TGAAAGTCTTCATCGTGCCGTGGGGAACCATTCCAACATCCCAT TCAGGAGGTGAAGC | SEQ ID NO: 882 | Homo sapiens phospholipase D family, member 4 (PLD4), mRNA [NM_138790] |
| 15 | A_24_P126057 | MBNL1 | AGAATATTGCTGCAACACTACTCTGTGATTGGTTATCTCTCATCA TGGATTGCTCACAA | SEQ ID NO: 883 | Homo sapiens muscleblind-like (Drosophila), mRNA (cDNA clone IMAGE:3935812), partial cds. [BC052961] |
| 16 | A_24_P312325 | C8orf15 | GTTGTTCAATGTGACTACTTGACTTTAGTTGGCTGTCGAATATGAAGTAG AAAACAGATTTCTG | SEQ ID NO: 884 | Homo sapiens chromosome 8 open reading frame 15 (C8orf15), mRNA [NM_001033662] |
| 17 | A_24_P350136 | LOC652370 | CCAGCTACCACCACCCTGCTGAAGATGAGGACTTCAATCTTAGGG ATGCCGTGGACAGCA | SEQ ID NO: 885 | PREDICTED: Homo sapiens similar to Keratin, type I cytoskeletal 18 (Cytokeratin-18) (CK-18) (Keratin-18) (K18) (LOC652370), mRNA [XR_019330] |
| 18 | A_24_P360499 | DDEF1IT1 | TGTTCCTTTTAATGTAGGGCAGGCTACTCGTATAGTTCAGATTTAACTT TGAAATGTAGGATAG | SEQ ID NO: 886 | Homo sapiens DDEF1 intronic transcript 1 (DDEF1IT1) on chromosome 8 [NR_002765] |
| 19 | A_24_P460763 | AK022443 | GTGAGTAGGAGGCTACTTAAGATGCCTAGTGGGTCTAAATGTCAA ATGCTATTGGCAGAT | SEQ ID NO: 887 | Homo sapiens cDNA FLJ12381 fis, clone MAMMA1002566. [AK022443] |
| 20 | A_24_P491923 | THC2491622 | CTTCTGTTGTTTCTCAATAAAGTAGACAAGTCCATCTGATGGGTG TTTAGTAGGGTATGA | SEQ ID NO: 888 | |

Fig. 3-2

| No. | Probe ID No. | Symbols of genes | Sequence | SEQ ID NO: | Descriptions of genes (letters and numbers within [ ] indicates GenBank accession No.) |
|---|---|---|---|---|---|
| 21 | A_24_P648264 | AL512741 | AAGAATTGAGTTAGAACTGCCCTATAATGTAATGCAGAATATTTGCCAATAATGCCTAGG | SEQ ID NO: 889 | Homo sapiens mRNA; cDNA DKFZp667N064 (from clone DKFZp667N064) [AL512741] |
| 22 | A_24_P558141 | A_24_P558141 | AACCCTGTCCTGCTGGCATAACCTCTCTACATTTTCCCATGAGCTGTGCTGATCAAACTAA | SEQ ID NO: 890 | |
| 23 | A_24_P642771 | AK024956 | ATTCTCCATATATTTTAGTGTGTCTATTGGGCTAGAAAGACAAAGAAGGGGAATGTGG | SEQ ID NO: 891 | Homo sapiens cDNA: FLJ21303 fis, clone COLO2107. [AK024956] |
| 24 | A_24_P693321 | AK123481 | ATCACAACTATGCCAAATAATCAATGCTACAAATGTCCAAAATTTTACTTTAAAACTGGAA | SEQ ID NO: 892 | Homo sapiens cDNA FLJ41487 fis, clone BRTHA2004350. [AK123481] |
| 25 | A_24_P69784 | PACS1 | AAGTTCCCTGATGAAGAGTCGTATCGAAGTTTATTCCGTTCATTGGCGTGGTGAAGGTG | SEQ ID NO: 893 | Homo sapiens phosphofurin acidic cluster sorting protein 1 (PACS1), mRNA [NM_018026] |
| 26 | A_24_P713312 | THC2639056 | TTTATATGGTCGGATGCTCCATGTTAGGATTAAGGGGTAATTAATAGTAATGTATGTGGA | SEQ ID NO: 894 | ALU8_HUMAN (P39195) Alu subfamily SX sequence contamination warning entry, partial (10%) [THC2639056] |
| 27 | A_24_P728115 | AK024937 | ACTGCATAGTCACTACTTTTAGTGAGTTTGAAATCTGTTGGAGAGGTATGTAAGTACGCA | SEQ ID NO: 895 | Homo sapiens cDNA: FLJ21284 fis, clone COLO1911. [AK024937] |
| 28 | A_24_P792389 | THC2671169 | ATGCTAAGGGTGGAGACTAAGGCATAGAAGTATGACTAGAATTGGCAGCTACACATTAGA | SEQ ID NO: 896 | |
| 29 | A_24_P79855 | ENST00000390643 | AAAGATTGGTCCCGTTTTACCCACGGAAGAGCTACCAAGAAGCGAACCTGATAGGAGATGG | SEQ ID NO: 897 | Homo sapiens hypothetical protein DKFZp566H0824, mRNA (cDNA clone MGC:129790 IMAGE:40021976), complete cds. [BC104430] |
| 30 | A_24_P883109 | AL833452 | GGGCAACTAGTCATCTACTAGTTAGCTTAGTAAGCTAAGGATTAAATCTAAGAGAATAGCA | SEQ ID NO: 898 | Homo sapiens mRNA; cDNA DKFZp686E08116 (from clone DKFZp686E08116). [AL833452] |
| 31 | A_24_P898619 | THC2635386 | AATGTAGCATGAGTGTTCCCGGTTAAAAGCCGTGTTTGAGTACTCTAAAGTACTTTTCT | SEQ ID NO: 899 | |
| 32 | A_24_P914102 | A_24_P914102 | TTAGTAGACGCTAGATTTCTCTACAAATGTAAAATGTTATTTTACTGTTGAAAATCAG | SEQ ID NO: 900 | |
| 33 | A_24_P626025 | DKFZp547E087 | TGTTATGAACATAGTCATGTTAAGTCTCCATTTAAATACAACGTGAAATACCAAAGTTA | SEQ ID NO: 901 | Homo sapiens cDNA FLJ30147 fis, clone BRACE2000266. [AK054709] |
| 34 | A_24_P930337 | THC2503773 | AGCAAGTGGAACCGACAACCCAAAATGACTTGAAGAATGTAATTTAAAATGTAGCATAG | SEQ ID NO: 902 | |
| 35 | A_24_P930391 | AK022351 | AAGTGGGTTTAATTTCCTTTCATGAAAGGAAAGATTAGCTTCATGCAACACTTGGTC | SEQ ID NO: 903 | Homo sapiens cDNA FLJ12289 fis, clone MAMMA1001788. [AK022351] |
| 36 | A_24_P931364 | AK022062 | TCCCGATCTGGAGTATGGTTGGAAGTCATTGTTGTTGTAAGGCATTATTTTCTGGT | SEQ ID NO: 904 | Homo sapiens cDNA FLJ12000 fis, clone HEMBB1001531. [AK022062] |
| 37 | A_24_P933514 | AK094334 | CGTAGTCCCACTGTGAGAATTTCCTTAGGTGGCATATATATACTACGTGAACTCTGGC | SEQ ID NO: 905 | Homo sapiens cDNA FLJ37015 fis, clone BRACE2010208. [AK094334] |
| 38 | A_24_P933548 | A_24_P933548 | CACGTCCACGTTTATATGCTTTATACCTGCAGAACTATAACCTAAGGGAAGGAATG | SEQ ID NO: 906 | |
| 39 | A_24_P934861 | A_24_P934861 | GGAAGTATCAAGCAGCAACAAATTCCAGTTTCTGGGAAATAGTGGACCAGATCGTCGCATGG | SEQ ID NO: 907 | |
| 40 | A_24_P935682 | AY358248 | AGTCAGTAATCAGGCATTCAAGCAATCAATATGAGGCTCTAACAATGCTTGAACAGTTATGCAAC | SEQ ID NO: 908 | Homo sapiens clone DNA166629 MRSS6228 (UNQ6228) mRNA, complete cds. [AY358248] |

Fig. 3-3

| No. | Probe ID No. | Symbols of genes | Sequence | SEQ ID NO: | Descriptions of genes (letters and numbers within [ ] indicates GenBank accession No.) |
|---|---|---|---|---|---|
| 41 | A_32_P105940 | A_32_P105940 | GTGCCAAGGTAAGCTAAGCTACCACACTTTTGGTTTTATTTCAAGGCACAAG ATGAAATAAGCATTG | SEQ ID NO: 909 | |
| 42 | A_32_P116997 | THC2719256 | AAACATTAGGTAGCAGCTTGTAGAGGATATATTTAGGGTCATGAT GTCCTTCTTGTTGGC | SEQ ID NO: 910 | BE147120 PM2-HT0224-221099-001-b10 HT0224 Homo sapiens cDNA, mRNA sequence [BE147120] |
| 43 | A_32_P120454 | THC2842550 | ACAGAATGAGATGACTGGACTGGTTCATCGTGTTTATTGGGAAGCT CAGGACAGGGTATGA | SEQ ID NO: 911 | |
| 44 | A_32_P121978 | A_32_P121978 | CAGATTAGACCACCTCATAATGAGTTGTTGATTGCACTTCAGATT GTCTTGATGGGGCAC | SEQ ID NO: 912 | |
| 45 | A_32_P12703 | THC2697162 | TTGAAAGGAAAGATATAGGGGCGAAGTGCCAGACTAAACGAATC CTAAGTAAATAGGGT | SEQ ID NO: 913 | |
| 46 | A_32_P131294 | BM854107 | AGTAGGGAAAAAGGTTTGTTCCTTAATTAGAAGTAGTCTGCTGGAAA TGCTAGCCACTCGTGC | SEQ ID NO: 914 | K-EST0138406 S22SNU16n1 Homo sapiens cDNA clone S22SNU16n1-145-F11 5', mRNA sequence [BM854107] |
| 47 | A_32_P132936 | THC2673888 | AAATGGAAGTATTGACGAGATTAAAGAGTGGTTAAGTCATGGCCA TGAATGAATTACCA | SEQ ID NO: 915 | QG5549 9ALPH (Q65549) Glycoprotein C, partial (4%) [THC2673888] |
| 48 | A_32_P145385 | AK001118 | CCGCAATTAAGACTCGAAGGAAGCTTAAATTCCAGCTTTTTGATT GTCAGGAAATGAGAT | SEQ ID NO: 916 | Homo sapiens cDNA FLJ10256 fis, clone HEMBB1000870. [AK001118] |
| 49 | A_32_P146844 | THC2639689 | CCTGTGGGGTGATTCCAGACTGAAGGCAAGGAAGACTGTCAGAAGAC ATCATGTGGCATTAA | SEQ ID NO: 917 | |
| 50 | A_32_P147969 | AL080232 | TAATGAGGCTCTTTCGGCATGAAGGGAAGGAAGACTGTCAGAAGAC GTCTGGAGAATTCTT | SEQ ID NO: 918 | Homo sapiens mRNA; cDNA DKFZp586A061 (from clone DKFZp586A061) [AL080232] |
| 51 | A_32_P151244 | AK022268 | GTAGTCAGATGTCACAGAGACAGTTATTTCATGTGTAAGCTTTTGA ACTGTTGATGTTGTT | SEQ ID NO: 919 | Homo sapiens cDNA FLJ12206 fis, clone MAMMA1000941. [AK022268] |
| 52 | A_32_P164573 | THC2611661 | AGGTGTTTTTCTATTAAGACTGAAGTAGTCTGAGAGCTTGGAAATT TTCAGTGCAAAATC | SEQ ID NO: 920 | RR12 SP1MX (P42344) Chloroplast 30S ribosomal protein S12, partial (11%) [THC2611661] |
| 53 | A_32_P167883 | THC2697442 | AGGTAATTGGGGGTATGACTTCAGTCACTCTTGAAATATTGGGAA CTAAATTGTGTCATT | SEQ ID NO: 921 | |
| 54 | A_32_P184039 | A_32_P184039 | ATCATTGTTAGTCTTGGCCGAAAATAGTTGTTATGTATCATGGC TAATAACTGACCAGC | SEQ ID NO: 922 | |
| 55 | A_32_P184330 | AK130741 | TGTGACCGTTTGTGACGAGTTATCTCAGTCCTCACATGAGTTCTT ACATGAGTCGGTCTA | SEQ ID NO: 923 | Homo sapiens cDNA FLJ27231 fis, clone SYNO6240. [AK130741] |
| 56 | A_32_P194372 | AK129547 | AGACCAGAGAAACATAGACCCATGATATTTGGACCAAGCATAGGT TAAAAGTAGGGGAGG | SEQ ID NO: 924 | Homo sapiens cDNA FLJ26636 fis, clone PRS00145. [AK129547] |
| 57 | A_32_P204565 | A_32_P204565 | CAGGACAGAATGATACACACGGGATGTGTTTCAGTGTGATGGAAA GATTGTTTCAGTGA | SEQ ID NO: 925 | |
| 58 | A_32_P208039 | AL049390 | TTTCATGTTTGAGGATTCAGATTGGGCTTATTCTCAAGGCATG TGGCAAACCTCACAA | SEQ ID NO: 926 | Homo sapiens mRNA; cDNA DKFZp58601318 (from clone DKFZp58601318) [AL049390] |
| 59 | A_32_P209552 | THC2663167 | CAATGTAAAGCCAGAATACAACGTCCTTTGTGAAGATTTTGAA ACCTATTTCGGTGAT | SEQ ID NO: 927 | ALU1_HUMAN (P39188) Alu subfamily J sequence contamination warning entry, partial (5%) [THC2663167] |
| 60 | A_32_P211048 | A_32_P211048 | GTTCAGAAAAACACCTAGTAGGTATTCAGTTCATATTGGAATGAA TGAGAAAATGAGCAG | SEQ ID NO: 928 | |
| 61 | A_32_P213509 | THC2663555 | GATTTGTTCCAGTGTTGGAGCCCTTTTTAATGAAAATTCTGAACA CCTACACTGGAAAAA | SEQ ID NO: 929 | |

Fig. 3-4

| No. | Probe ID No. | Symbols of genes | Sequence | SEQ ID NO: | Descriptors of genes (letters and numbers within [ ] indicates GenBank accession No.) |
|---|---|---|---|---|---|
| 62 | A_32_P216122 | AK130891 | TTGTTGGTGTATATGTTGGGAGGCATTGAAGAATTGAGTAC ACATATATATGGGTC | SEQ ID NO: 930 | Homo sapiens cDNA FLJ27381 fis, clone UBA07680. [AK130891] |
| 63 | A_32_P224638 | THC2731042 | ACACCAGTCTAACTGCTAGCTTAATGAGCATGGAAACAAAATAGC TCAATCTCTTCTAAC | SEQ ID NO: 931 | Q4SSA7_TETNG (Q4SSA7) Chromosome 11 SCAF14479, whole genome shotgun sequence. (Fragment), partial (5%) [THC2731042] |
| 64 | A_32_P227110 | THC2512148 | TAAAAGAAATCCTTTTGATTCAGCCACTGTGTATTGATAATGGCT TATTATTACAATCA | SEQ ID NO: 932 | |
| 65 | A_32_P232851 | THC2645886 | CTTTGAAAGGATATCCTTGACATTCGTTTTCGAGAAAATTGAGG TGACTGACTTATTC | SEQ ID NO: 933 | Q9P3E1_NEUCR (Q9P3E1) Related to rna-binding protein fus/tis, partial (5%) [THC2645886] |
| 66 | A_32_P25243 | THC2656826 | GGGCTCTGGGCACCATTGGAAGACTGGAGATATAAATGACAAGTGA TTTATTTGTTTTCA | SEQ ID NO: 934 | |
| 67 | A_32_P33304 | ANK3 | TGTTGGAATACGGGCGGGTGATCTCTCTTTTATAAAGTCACCTGAT TTAAAGGAAAGATGA | SEQ ID NO: 935 | Homo sapiens cDNA FLJ44903 fis, clone BRAMY3005184, highly similar to Mus musculus ankyrin 3, epithelial (Ank3). [AK126811] |
| 68 | A_32_P3342 | THC2676548 | TATAGCATTTTCTGAAGATCATGTTGTACTCTTCTTCGTCTAGA TGATTTGGTCAACAG | SEQ ID NO: 936 | ALU7_HUMAN (P39194) Alu subfamily SQ sequence contamination warning entry, partial (19%) [THC2676548] |
| 69 | A_32_P40673 | A_32_P40673 | CATGACAGTTGATATTAGGAACAGGCTACCTACTCGTTGAGTGTG ACAGCCTGATATGTA | SEQ ID NO: 937 | |
| 70 | A_32_P41099 | THC2658419 | AGGGCGAGAAATATTTGGGTTCGTCGGTTATTAGTAAAGTGTCT TTGAGTATTGTGTC | SEQ ID NO: 938 | |
| 71 | A_32_P42976 | THC2713078 | CTTATCCTTTCCTTTCTGTGGTGTCAACCTGCCAACATTGTGGGCT CATTCTTTCTGGCTA | SEQ ID NO: 939 | |
| 72 | A_32_P43878 | DB111455 | ATGTGAGAAAGGTTCTTTAAGGTTTAATGACCAAGTTCCATGTG AGCTCTTACTTGGGA | SEQ ID NO: 940 | DB111455 THYMU2 Homo sapiens cDNA clone THYMU2015028 5', mRNA sequence [DB111455] |
| 73 | A_32_P542 | AF131782 | GAGGCTCTTACGGATCTAACTTCACTTAAGCTGGGAGGAAAATGTCTT ATAAATAACAACAG | SEQ ID NO: 941 | Homo sapiens clone 24941 mRNA sequence. [AF131782] |
| 74 | A_32_P60551 | BU567588 | GCAGAGTACAAGGCTTTGATGGGTGTCATCTATTGATCTATTCCTAGT ACATAAAATTTAGCC | SEQ ID NO: 942 | AGENCOURT_10399418 NIH_MGC_82 Homo sapiens cDNA clone IMAGE:6614194 5', mRNA sequence [BU567586] |
| 75 | A_32_P65067 | THC2618074 | CCGCAAAGTGAATTTAAACTTGACTTATTTATGCCGTTCTGCAT AGCAACAGGAAAAGT | SEQ ID NO: 943 | |
| 76 | A_32_P67209 | BU726026 | CTGACTTATATTTATTCTCGCACCTACGCTGCACGTGACACTGC TATTCTTTCAGAGAAG | SEQ ID NO: 944 | UI-E-C10-aac-g-02-0-UI.s1 UI-E-C10 Homo sapiens cDNA clone UI-E-C10-aac-g-02-0-UI 3', mRNA sequence [BU726029] |
| 77 | A_32_P70875 | CD239706 | CTTTGTTTGTTGAGAAGTTCCTAATGACGTAGGAGAACAAAGTGACAG TTTCGTTATTTACTG | SEQ ID NO: 945 | FMPBXF03 FMP Homo sapiens cDNA, mRNA sequence [CD239706] |
| 78 | A_32_P71171 | A_32_P71171 | TCTAGATAGTAATAGGAACCAAGAATCCAGCCTGGTGATGGCGTG GAGGGACTGATTGAA | SEQ ID NO: 946 | |
| 79 | A_32_P79103 | BM932034 | GTGCTACAGAATGAAAATAGCATTTAGGAAGGTTGAGTCAAGAGG TGCAAGTGGGCCATA | SEQ ID NO: 947 | UI-E-EJi-aji-k-24-0-UI.r1 UI-E-EJI Homo sapiens cDNA clone UI-E-EJi-aji-k-24-0-UI 5', mRNA sequence [BM932034] |
| 80 | A_32_P88987 | AK022346 | ATGGAAGTTAGTACCCAGGGCTTACCAAAAGGTCAGGTTTATATA AAGTTGGCGTTCCTTT | SEQ ID NO: 948 | Homo sapiens cDNA FLJ12284 fis, clone MAMMA1001767. [AK022346] |

Fig. 3-5

| No. | Probe ID No. | Symbols of genes | Sequence | SEQ ID NO: | Descriptions of genes (letters and numbers within [ ] indicates GenBank accession No.) |
|---|---|---|---|---|---|
| 81 | A_32_P89097 | AL134462 | TTCATGGAGCTTCTAGTCAAGCGAGACCGCACTAAACAGTAAAGGGACAAATAGGATTACT | SEQ ID NO: 948 | DKFZp547J085_r1 547 (synonym: hfbr1) Homo sapiens cDNA clone DKFZp547J085 5', mRNA sequence [AL134462] |
| 82 | A_32_P90468 | A_32_P90468 | AAGCCAGGAATAATTTTCTATCTGCATGTACCTAACCTCCTGGAAGTTATCATGAGACCCT | SEQ ID NO: 949 | |
| 83 | A_32_P91328 | THC2641695 | GTTAGCGCAATAATGTCATTGAAGTCTTTAAGTCTGTAGCCTGACTCTAAGGCCAGGGTTCA | SEQ ID NO: 950 | |
| 84 | A_32_P98940 | THC2745859 | AAGAGTATTCCCAAGATAGCAAAGGTGTGTTGTTTTTAGGAGTGTATTTCAGGTAGTTA | SEQ ID NO: 951 | |
| 85 | A_23_P102060 | SSFA2 | GTATCATCCAAATAATGGGGGCTATGACTGAATGAATAGAAATGAATAAGGTGGTGTTT | SEQ ID NO: 952 | Homo sapiens sperm specific antigen 2 (SSFA2), mRNA [NM_006751] |
| 86 | A_23_P102235 | SNRPG | ACAACAGAAGAATATTGGAATGGTGGTAATACAGAGAAATAGTATCATCATGTTAGAAGC | SEQ ID NO: 953 | Homo sapiens small nuclear ribonucleoprotein polypeptide G (SNRPG), mRNA [NM_003096] |
| 87 | A_23_P104054 | C1orf9 | TAAATTTCTTCCTGTCTGCACAATTAGCTATTCAGAGGAAGAGGGCCTGATTTATAGA | SEQ ID NO: 954 | Homo sapiens chromosome 1 open reading frame 9 (C1orf9), transcript variant 2, mRNA [NM_016227] |
| 88 | A_23_P106131 | KTN1 | ATGTTTTCACCCTTCTACTTTGTCAGAAAACTGAACAGAGTTTTGTCTTTTCTAATCC | SEQ ID NO: 955 | Homo sapiens kinectin 1 (kinesin receptor) (KTN1), transcript variant 1, mRNA [NM_182926] |
| 89 | A_23_P106145 | ERO1L | ATTGTGTTGGTTGTTTAAATGTCGTCTGTGGGGAAAAGGTTCAGACTCAGGGGTTGGGCA | SEQ ID NO: 956 | Homo sapiens ERO1-like (S. cerevisiae) (ERO1L), mRNA [NM_014584] |
| 90 | A_23_P108835 | YPEL5 | AAAGTGACTGTCGTGATACAGTTAAGTTGGTCGTCCTATTTGGCCAGTGGGCTGGTTGGAAAG | SEQ ID NO: 957 | Homo sapiens yippee-like 5 (Drosophila) (YPEL5), mRNA [NM_016061] |
| 91 | A_23_P109774 | ZBTB11 | GCCTCTCCCAGTTTACTTTAAAAATGGCTTTAAGGATAAAGAATAAATGATAGGCTGTG | SEQ ID NO: 958 | Homo sapiens zinc finger and BTB domain containing 11 (ZBTB11), mRNA [NM_014415] |
| 92 | A_23_P110352 | MAP2K1IP1 | ACTGAGACAAGTTGTGGAAGTTTCTAATCTGCACAGTGGTTTCAGTGTGTACGTTATCTT | SEQ ID NO: 959 | Homo sapiens mitogen-activated protein kinase kinase 1 interacting protein 1 (MAP2K1IP1), mRNA [NM_021970] |
| 93 | A_23_P110611 | ZH2C2 | CTCTTGAAAAGGACAGAGACTTTCAGTCGTTGTTGGACTCTTCAAACACAGGTTCTTGAATACGTTAA | SEQ ID NO: 960 | Homo sapiens zinc finger, H2C2 domain containing (Zh2C2), mRNA [NM_017676] |
| 94 | A_23_P110704 | SLU7 | CCTCTTTCCTTGGACAGTAGCAACTAGTCAGAAGACCATCGAAGATAGATGCAGCTGATA | SEQ ID NO: 961 | Homo sapiens SLU7 splicing factor homolog (S. cerevisiae) (SLU7), mRNA [NM_006425] |
| 95 | A_23_P110811 | COX7C | AGCCTCTGGAAGTGGAATCACAAACTAGAACTCATATCGATAGATATGTTTGTCAATAA | SEQ ID NO: 962 | Homo sapiens cytochrome c oxidase subunit VIIc (COX7C), nuclear gene encoding mitochondrial protein, mRNA [NM_001867] |
| 96 | A_23_P114616 | ANKRD13C | GTCTCAAGAATGCATCTGTCAAGTTTTTAGACTGACCAGTAGCTTAAACGTTTTTTCAGG | SEQ ID NO: 963 | Homo sapiens mRNA; cDNA DKFZp566D1346 (from clone DKFZp566D1346), [AL136717] |
| 97 | A_23_P11652 | USP1 | TTGGGCATGGACTAATTTTGTATCTGTTAAGTCATCATATTCTGCACGATCGTATATAGTAC | SEQ ID NO: 964 | Homo sapiens ubiquitin specific peptidase 1 (USP1), transcript variant 1, mRNA [NM_003368] |
| 98 | A_23_P11685 | PLA2G4A | GAAATGGCAGCAGTTTCTGATGCTGAGGCAGTTTGCAATCCATGACAACTGGATTTAAA | SEQ ID NO: 965 | Homo sapiens phospholipase A2, group IVA (cytosolic, calcium-dependent) (PLA2G4A), mRNA [NM_024420] |

Fig. 3-6

| No. | Probe ID No. | Symbols of genes | Sequence | SEQ ID NO: | Descriptions of genes (letters and numbers within [ ] indicates GenBank accession No.) |
|---|---|---|---|---|---|
| 99 | A_23_P117163 | RCBTB1 | AAGTGAAGGACCACTTCTCATATTAGATTACTAAGTCATTTGTATGAAATATGTGGCAG | SEQ ID NO: 967 | Homo sapiens regulator of chromosome condensation (RCC1) and BTB (POZ) domain containing protein 1 (RCBTB1), mRNA [NM_018191] |
| 100 | A_23_P117721 | RPS17 | AATTATGTTCCTGAGGTCTGAGCCTTGGATCAGGAGAATTATTGAAGTAGATCCTGAACACT | SEQ ID NO: 968 | Homo sapiens ribosomal protein S17 (RPS17), mRNA [NM_001021] |
| 101 | A_23_P117852 | KIAA0101 | TACTGCTGCCATTTTATTGGTCTTTGATTATTGGAATGGTGCCATATTGTCAGTCGTTC | SEQ ID NO: 969 | Homo sapiens KIAA0101 (KIAA0101), transcript variant 1, mRNA [NM_014736] |
| 102 | A_23_P118516 | FAM18B | TATTCTGTAGATTGTTTTCAGGAGAAAGTTTTGGTTCTATGGTAAGAAGTGAGCACTTTG | SEQ ID NO: 970 | Homo sapiens family with sequence similarity 18, member B (FAM18B), mRNA [NM_016078] |
| 103 | A_23_P120048 | BAZ2B | TATTTCGTCTGAAGGTAATGATAAGCTATACAGTCTGTACAGTAATTATCGTCTACGAAG | SEQ ID NO: 971 | Homo sapiens bromodomain adjacent to zinc finger domain, 2B (BAZ2B), mRNA [NM_013450] |
| 104 | A_23_P120316 | MTHFD2 | AGGATTATTCCTTGGTATTAGTACTCATTTTATGTATGTTACCCTTCAGTAAGTTCTCCC | SEQ ID NO: 972 | Homo sapiens methylenetetrahydrofolate dehydrogenase (NAD+ dependent) 2, methenyltetrahydrofolate cyclohydrolase (MTHFD2), nuclear gene encoding mitochondrial protein, transcript variant 1, mRNA [NM_006636] |
| 105 | A_23_P1206 | RPS24 | TTTTGGATTCAGAAGTCATTTGGTGGTGGCAAGACAACTGGCTTTGGCATAGTTTATGAT | SEQ ID NO: 973 | Homo sapiens ribosomal protein S24 (RPS24), transcript variant 2, mRNA [NM_001026] |
| 106 | A_23_P121366 | IFT57 | TGGAACACACTACTCGCAATCAAAAGCTGAAGGAAGAAGTCCAACATGACTAGGAACATGC | SEQ ID NO: 974 | Homo sapiens intraflagellar transport 57 homolog (Chlamydomonas) (IFT57), mRNA [NM_018010] |
| 107 | A_23_P121622 | SULT1B1 | GAAATAGAGATTGTCTGTAGTTGATTGAAACGAGGGCAGTTATGAATTGATTTGGGGAAT | SEQ ID NO: 975 | Homo sapiens mRNA for ST1B2, complete cds. [D89479] |
| 108 | A_23_P121825 | FLJ13611 | CATGTGTTACTGTTACAAAAGTTTCCTCTCCATGTAATCACACTTAGTTATGAGGAAAG | SEQ ID NO: 976 | Homo sapiens hypothetical protein FLJ13611 (FLJ13611), mRNA [NM_024941] |
| 109 | A_23_P121875 | C5orf28 | TTAAAACATGTTGGGCTACACAGTAGGACACTTTACTGAAGTAGTATTTTTGGTATGTCTAGGC | SEQ ID NO: 977 | Homo sapiens chromosome 5 open reading frame 28 (C5orf28), mRNA [NM_022483] |
| 110 | A_23_P122007 | C5orf30 | ATCAGATTCTCGTTCGATTGGGCTGGAAATGTTTCGCTGTGTATATTTTAAAGTAAATTGCAC | SEQ ID NO: 978 | Homo sapiens chromosome 5 open reading frame 30 (C5orf30), mRNA [NM_033211] |
| 111 | A_23_P122174 | XRCC4 | AAACCAACTGATCTCTCTCTGGTTTGGGAGGGGGGTCAGCTTCAGCTGCTGTAAGTAAAGATGATTCCATTAT | SEQ ID NO: 979 | Homo sapiens X-ray repair complementing defective repair in Chinese hamster cells 4 (XRCC4), transcript variant 3, mRNA [NM_022550] |
| 112 | A_23_P123315 | BC067244 | CTTCCAAATCACTGGTTTGGACGTGGATACATGCTCATTTCTGTACATGATGCAT | SEQ ID NO: 980 | Homo sapiens cDNA clone IMAGE:4807381, partial cds. [BC067244] |
| 113 | A_23_P123343 | NUDCD1 | TTGGCGCTCTTTGTACTGGTGAAAATGGAAATATTCAGTGGTACCTGGAGGTCTGGACAGTTATACTG | SEQ ID NO: 981 | Homo sapiens NudC domain containing 1 (NUDCD1), mRNA [NM_032869] |
| 114 | A_23_P123608 | JAK2 | GGATAACATGGCTGGCTGGATGAAAGAAATGACCTTCATTGTTGAGAGACCAAGTAGATTTACAGA | SEQ ID NO: 982 | Homo sapiens Janus kinase 2 (a protein tyrosine kinase) (JAK2), mRNA [NM_004972] |
| 115 | A_23_P127579 | PTS | GTGGTTTATAAAGGAGGAATAGCTATTGGGGGTTAGCATTTACCCTTGCTGGCCCAGTTGTTTCT | SEQ ID NO: 983 | Homo sapiens 6-pyruvoyltetrahydropterin synthase (PTS), mRNA [NM_000317] |
| 116 | A_23_P128060 | ZNF26 | ATCCGTTCGCACTAGGTACAGGTGAGCTCAAAGTGGTACAGAGGCATTTTACCCTGTTGGATAATGGTAATCTCTTT | SEQ ID NO: 984 | Homo sapiens zinc finger protein 26 (ZNF26), mRNA [NM_019591] |
| 117 | A_23_P128192 | PFDN5 | CAGGTCCATTGGTCAGCTCAAAGTTGGTACAGAGGCAAGTATGTGGAAGCCAAGGACTGTCT | SEQ ID NO: 985 | Homo sapiens prefoldin subunit 5 (PFDN5), transcript variant 1, mRNA [NM_002624] |

Fig. 3-7

| No. | Probe ID No. | Symbols of genes | Sequence | SEQ ID NO: | Descriptions of genes (letters and numbers within [ ] indicates GenBank accession No.) |
|---|---|---|---|---|---|
| 118 | A_23_P128930 | PSMC6 | GAACAAGCAAGATTAGACATACTGAAAATCGATGCAGGTCCGATTACAAAGCATGGTGAA | SEQ ID NO: 986 | Homo sapiens proteasome (prosome, macropain) 26S subunit, ATPase, 6 (PSMC6), mRNA [NM_002806] |
| 119 | A_23_P130444 | ZNF701 | CTCCTTGGCAGAATATCATAACGTTCATTTTTGAGGTAATAGTTACAATGCGGTGAGCAC | SEQ ID NO: 987 | Homo sapiens zinc finger protein 701 (ZNF701), mRNA [NM_018260] |
| 120 | A_23_P133375 | SLC25A46 | CAGTGCTAGCAACGTTAATTCTCATACATTTATAGAGTTTGGTTTGCTTTGCTAGTTGTG | SEQ ID NO: 988 | Homo sapiens solute carrier family 25, member 46 (SLC25A46), mRNA [NM_138773] |
| 121 | A_23_P133648 | FAM8A1 | ACTTCGCCGAATTAGAAATGAGTGTTTTTAGATTCAAGTGACGGTAAAAGGATTTGTT | SEQ ID NO: 989 | Homo sapiens family with sequence similarity 8, member A1 (FAM8A1), mRNA [NM_016255] |
| 122 | A_23_P134786 | PHF20L1 | AGTTGTATGTGCCCCCAGTGCTACATACGCAGGTATGCGTAAGTGTGTATGCTTGTTTTA | SEQ ID NO: 990 | Homo sapiens PHD finger protein 20-like 1 (PHF20L1), transcript variant 1, mRNA [NM_016018] |
| 123 | A_23_P135494 | CLIC4 | CTCGTCAAGCCGTAAGTGTTGAACGAATTGGAGTATTTGTTTATAATTTCTTGAACAGG | SEQ ID NO: 991 | Homo sapiens chloride intracellular channel 4 (CLIC4), mRNA [NM_013943] |
| 124 | A_23_P135499 | CLIC4 | CTTCCCTTTTTGATGTAGATGCAGATATTCTATACAGATCTGATTGTCTTTTACTAGGAC | SEQ ID NO: 992 | Homo sapiens chloride intracellular channel 4 (CLIC4), mRNA [NM_013943] |
| 125 | A_23_P13822 | STYK1 | ACGGCTTAGTAGCTCAGTCTTAACAAGAGGTAGAAAAGAATGTAATCTGATATGGAAGGA | SEQ ID NO: 993 | Homo sapiens serine/threonine/tyrosine kinase 1 (STYK1), mRNA [NM_018423] |
| 126 | A_23_P138308 | CD58 | AACCTGTATCCAAGCAAGCGGTCATTAATTCTTAAAGGGCTCTTTTCAGTTATACCCATACCATT | SEQ ID NO: 994 | Homo sapiens CD58 molecule (CD58), mRNA [NM_001779] |
| 127 | A_23_P140069 | FBXL3 | TAACCCGCAGTGGAATAGATTATTCTTAAAGGGCTCTTTTCAGTAGTGTGACTTTTAGA | SEQ ID NO: 995 | Homo sapiens F-box and leucine-rich repeat protein 3 (FBXL3), mRNA [NM_012158] |
| 128 | A_23_P140301 | PSMA3 | TGAAGTAGAAGTCAGGTCGGGTTGGTCAATTAACTAATGGAAGACATGAAATGTTCCAAA | SEQ ID NO: 996 | Homo sapiens proteasome (prosome, macropain) subunit, alpha type, 3 (PSMA3), transcript variant 1, mRNA [NM_002788] |
| 129 | A_23_P141549 | RPS7 | GTCAAAGTAGATGGCAGCCGGCTCATAAAGGTTCATTGGACAAAGCAAGGAGAACAAT | SEQ ID NO: 997 | Homo sapiens ribosomal protein S7 (RPS7), mRNA [NM_001011] |
| 130 | A_23_P143958 | RPL22L1 | ATTGGCTTCGAGTGCTGGTTGGATGTGACGAGGAGACCTACGAACTTCGTTACTTCCAGATTA | SEQ ID NO: 998 | Homo sapiens ribosomal protein L22-like 1 (cDNA clone IMAGE:4865966), [BC049823] |
| 131 | A_23_P144224 | TLOC1 | ATGGGGATTGGTGAAGAGGAGGATGAGGAAAATGATGAGAAACACCTAAATGTTCAC | SEQ ID NO: 999 | Homo sapiens translocation protein 1 (TLOC1), mRNA [NM_003262] |
| 132 | A_23_P144497 | RPS3A | CCAAATCGGGAAGAAGAATGATGGAAATGATGACCCGAGAGGTGCAGACAAATGACTTGAA | SEQ ID NO: 1000 | Homo sapiens ribosomal protein S3A (RPS3A), mRNA [NM_001006] |
| 133 | A_23_P144684 | ANKRD32 | AAACTTCTACAAAACTCTAGTATGGGCTTCTGACTTTTTCCAGGGTGTAGAATTTGACTC | SEQ ID NO: 1001 | Homo sapiens ankyrin repeat domain 32 (ANKRD32), mRNA [NM_032290] |
| 134 | A_23_P145397 | CCNC | TAGTAGACCAGTTGGAAATAAAACATTGGACAGATTTCAGTAATGTCTTCAGTTGGAACAC | SEQ ID NO: 1002 | Homo sapiens cyclin C (CCNC), transcript variant 1, mRNA [NM_005190] |
| 135 | A_23_P14564 | GPR65 | AACAAGTTAAATTGTTGTTGGCTGCAGTTCTGTAGTGTTTGTAACGCAAAGAGGAAG | SEQ ID NO: 1003 | Homo sapiens G protein-coupled receptor 65 (GPR65), mRNA [NM_003608] |
| 136 | A_23_P145777 | NDUFA4 | ACGGCTGCTTAGAATGAATGAAGGTCTTGCAGAAGCCACATCCCGCACAATTTTCCACTTAACCA | SEQ ID NO: 1004 | Homo sapiens NADH dehydrogenase (ubiquinone) 1 alpha subcomplex, 4, 9kDa (NDUFA4), nuclear gene encoding mitochondrial protein, mRNA [NM_002489] |
| 137 | A_23_P148347 | FAM29A | TTGGACACGAAAGGTCAAGGAATGGGAAGCCATTTTGATTCTTGAGTAATCTTGTAAGC | SEQ ID NO: 1005 | Homo sapiens family with sequence similarity 29, member A (FAM29A), mRNA [NM_017645] |

Fig. 3-8

| No. | Probe ID No. | Symbols of genes | Sequence | SEQ ID NO: | Descriptions of genes (letters and numbers within [ ] indicates GenBank accession No.) |
|---|---|---|---|---|---|
| 138 | A_23_P14708 | SUHW4 | TCTTTGTACCTCCATAAGTGTTAGCCTGCCAGGGCTGTAAGCTTACCTTAATTAAACTT | SEQ ID NO: 1006 | Homo sapiens suppressor of hairy wing homolog 4 (Drosophila) (SUHW4), transcript variant 1, mRNA [NM_017661] |
| 139 | A_23_P14734 | RPS27L | TACAAGATCACCACAGGTTTTCAGGCATGGTCAGACAGTGGTTCTTTGTGTAGGTGTTCA | SEQ ID NO: 1007 | Homo sapiens ribosomal protein S27-like (RPS27L), mRNA [NM_015920] |
| 140 | A_23_P147404 | A_23_P147404 | TGGGGTGAACATGAAATTGATTACATATTTTGTTGGATGGTGAGCAGCGTCGCTCTCATGTG | SEQ ID NO: 1008 | |
| 141 | A_23_P149775 | ARHGAP12 | TGTATATAAAAGACAGGGTTTGGAAGGTTTTGTTACAGGGAGCATGGTCTGTTGAAGAT | SEQ ID NO: 1009 | Homo sapiens Rho GTPase activating protein 12 (ARHGAP12), mRNA [NM_018287] |
| 142 | A_23_P149892 | GALNACT-2 | CATGGTGGTCAGAATAGATGAGGATGAGCATAGCAGTGTTTGTTTGTTTTGCTTTGAATTTC | SEQ ID NO: 1010 | Homo sapiens chondroitin sulfate GalNAcT-2 (GALNACT-2), mRNA [NM_018590] |
| 143 | A_23_P150129 | SAPS3 | TTACCTTGTTAACAAGCATCACGAATGAACATTTCAAGAGCAATCTGGATATTTAACAGAC | SEQ ID NO: 1011 | Homo sapiens SAPS domain family, member 3 (SAPS3), mRNA [NM_018312] |
| 144 | A_23_P151018 | LEMD3 | CCCCATCTTGTAACCTGTTGGAAGAGTGAATGTAAAAATAGTTGTGGGATTTTAAAAGG | SEQ ID NO: 1012 | Homo sapiens LEM domain containing 3 (LEMD3), mRNA [NM_014319] |
| 145 | A_23_P152002 | BCL2A1 | TGTAACCATATTTGAAGGTATTGTCATCAAGAAAGTTCTACGACAGCAAATTGG | SEQ ID NO: 1013 | Homo sapiens BCL2-related protein A1 (BCL2A1), mRNA [NM_004049] |
| 146 | A_23_P154330 | TXNDC9 | CTCAGTTCTTAAATTATCTGGGAAGGGCTGGATTCTCTGTATTTTGAGATTGACTTATC | SEQ ID NO: 1014 | Homo sapiens thioredoxin domain containing 9 (TXNDC9), mRNA [NM_057783] |
| 147 | A_23_P154387 | STK17B | TACCCAATGCCGCATGAACTGTTCAGATTGGTCTGTGTTAGGACATTTTCTTTGACTCA | SEQ ID NO: 1015 | Homo sapiens serine/threonine kinase 17b (STK17B), mRNA [NM_004226] |
| 148 | A_23_P155765 | HMGB2 | TAAAAATGCAGGTTGTAGCTTTTGATGGGCTAGTCACAGTTAGATTTACAGGTTC | SEQ ID NO: 1016 | Homo sapiens high-mobility group box 2 (HMGB2), mRNA [NM_002129] |
| 149 | A_23_P155815 | NCAPG | AAGTTAGGAAAGACGAATGGAGGTGGAATCCTTTAAGAATTATGTCAGTTATTGGTTTAA | SEQ ID NO: 1017 | Homo sapiens non-SMC condensin I complex, subunit G (NCAPG), mRNA [NM_022346] |
| 150 | A_23_P156356 | TMEM161B | AGGTTTGGACCTGGCATATTTTATTCTGTGATCCTAACTAGTTCCTTTAATAGG | SEQ ID NO: 1018 | Homo sapiens transmembrane protein 161B (TMEM161B), mRNA [NM_153354] |
| 151 | A_23_P156842 | EEF1E1 | AAGAAAAAGCAATGCTTCAGCAGTGGTTAGAATACAGGGTCACTCAAGTAGATGGGCACT | SEQ ID NO: 1019 | Homo sapiens eukaryotic translation elongation factor 1 epsilon 1 (EEF1E1), mRNA [NM_004280] |
| 152 | A_23_P157449 | POLR2K | GGTCTCTGTTGCTGTTCAAAATATCTCTTGTACAGTACTGCACCATTTTAGATGTGGTTGAC | SEQ ID NO: 1020 | Homo sapiens polymerase (RNA) II (DNA directed) polypeptide K, 7.0kDa (POLR2K), mRNA [NM_005034] |
| 153 | A_23_P157452 | POLR2K | GGAATGTCTTCAGTTATACTTGGATTTGGTCTTCTCCCATTCTGATTGTTGTATAGCTT | SEQ ID NO: 1021 | Homo sapiens polymerase (RNA) II (DNA directed) polypeptide K, 7.0kDa (POLR2K), mRNA [NM_005034] |
| 154 | A_23_P159650 | COX7B | CAAATACGGTAATGCTGTATTAGCTAGTAGTGGAGCCACTTTCTGTATTGTTACATGGACATA | SEQ ID NO: 1022 | Homo sapiens cytochrome c oxidase subunit VIIb (COX7B), nuclear gene encoding mitochondrial protein, mRNA [NM_001866] |
| 155 | A_23_P159839 | C1GALT1C1 | TCCAAATCAGATGCATGGATGATGATGTATACCGACCGCTTAGGGGCATTTGGGCATAT | SEQ ID NO: 1023 | Homo sapiens C1GALT1-specific chaperone 1 (C1GALT1C1), transcript variant 1, mRNA [NM_152692] |
| 156 | A_23_P160466 | SLC19A2 | CTTGTATGTGGCCATATTTATAGAATGCTGAACTCAATGTGCAAGTTGTACTGTATGGA | SEQ ID NO: 1024 | Homo sapiens solute carrier family 19 (thiamine transporter), member 2 (SLC19A2), mRNA [NM_006996] |

Fig. 3-9

| No. | Probe ID No. | Symbols of genes | Sequence | SEQ ID NO: | Descriptors of genes (letters and numbers within [ ] indicates GenBank accession No.) |
|---|---|---|---|---|---|
| 157 | A_23_P161091 | ZMYM1 | GAGGTATTTTCCTAAGTGGTATTGTGACGGTGTATACTGTTCTTG AGGTTGTCTTCTCTG | SEQ ID NO: 1025 | Homo sapiens zinc finger, MYM-type 1 (ZMYM1), mRNA [NM_024772] |
| 158 | A_23_P162279 | CCDC91 | AGTACAGGCATATATGAAATCTTTCCCAGTATTTCAGAATGTACT TAATGACAGGGAGG | SEQ ID NO: 1026 | Homo sapiens coiled-coil domain containing 91 (CCDC91), mRNA [NM_018318] |
| 159 | A_23_P162596 | ACTR6 | TTAACGGCTTCACTGGACGTTTTCCTTAGAAGGTAGTTTTGTGT GACTGTGACTAAACT | SEQ ID NO: 1027 | Homo sapiens ARP6 actin-related protein 6 homolog (yeast) (ACTR6), mRNA [NM_022496] |
| 160 | A_23_P162866 | HSP90AA1 | CTGGGTATTGTGATGAAGATGACCCTACTGCTGATGATACCAGTGCT GCTGTAACTGAAGAA | SEQ ID NO: 1028 | Homo sapiens heat shock protein 90kDa alpha (cytosolic), class A member 1 (HSP90AA1), transcript variant 2, mRNA [NM_005348] |
| 161 | A_23_P163113 | PRPF39 | TAGTAATAGGGGGAAAATGTCAATTAGTAGCTTACCACAGATACT GTTTCCTAGGATTTA | SEQ ID NO: 1029 | Homo sapiens PRP39 pre-mRNA processing factor 39 homolog (S. cerevisiae) (PRPF39), mRNA [NM_017922] |
| 162 | A_23_P163216 | ATP8B4 | ATCAGTGTATTTTCGATAAAGTGATTGGGGGATATTTGTGTGAAA ACCTGAGTTCTGTCA | SEQ ID NO: 1030 | Homo sapiens ATPase, Class I, type 8B, member 4 (ATP8B4), mRNA [NM_024837] |
| 163 | A_23_P167828 | RWDD1 | GAGGATGCTGGAAACAACATCGTGGAGGTAGAGAAGTCTTTGTTCGAA GAAATGGATGACTG | SEQ ID NO: 1031 | Homo sapiens RWD domain containing 1 (RWDD1), transcript variant 2, mRNA [NM_016104] |
| 164 | A_23_P16817 | CLK1 | ATGGAAAGGATTCTTGGACCTCTACCAAACATATGATACAGAAAA ACCAGGAAAACGTAAA | SEQ ID NO: 1032 | Homo sapiens CDC-like kinase 1 (CLK1), transcript variant 1, mRNA [NM_004071] |
| 165 | A_23_P168656 | GTPBP10 | AATTGTGGATTTCTGATAGAATGTCTTCTACTGAGGCACCATCA AAGCACTGTGTTACT | SEQ ID NO: 1033 | Homo sapiens GTP-binding protein 10 (putative) (GTPBP10), transcript variant 2, mRNA [NM_033107] |
| 166 | A_23_P168974 | SDCBP | GGAAACGACAAGTTCATCTTGAGAATTTATACAGACTGGTCGAG AACAACCATCCTCAG | SEQ ID NO: 1034 | Homo sapiens cDNA FLJ46804 fis, clone TRACH3032570, highly similar to Homo sapiens syndecan binding protein (syntenin) (SDCBP), [AK128645] |
| 167 | A_23_P169050 | MRPS28 | GAGCACAACAGATACAACTGTACTAGAGGGTAATGCAGTTCTGT TGGGAATGCAGGAGA | SEQ ID NO: 1035 | Homo sapiens mitochondrial ribosomal protein S28 (MRPS28), nuclear gene encoding mitochondrial protein, mRNA [NM_014018] |
| 168 | A_23_P169576 | EXOC6 | ATGTGAAATCTTCCCTTTGCCTTTTCAGGATTTAGGCCTGTAAGA AACTATGCGTGATTC | SEQ ID NO: 1036 | Homo sapiens exocyst complex component 6 (EXOC6), transcript variant 2, mRNA [NM_001013848] |
| 169 | A_23_P17021 | SCRN3 | GTCAAAGTTAGTTCTTAGTGATCATCATGGTCAAGCTAATATTAGTT CTTAGTGATCAGTGG | SEQ ID NO: 1037 | Homo sapiens secernin 3 (SCRN3), mRNA [NM_024583] |
| 170 | A_23_P170233 | CSTA | AACTGGCTACTGAGTCAGTCATCAGTCCTTGCTGATAAATATAACCATCA ATAAGAAGCATCT | SEQ ID NO: 1038 | Homo sapiens cystatin A (stefin A) (CSTA), mRNA [NM_005213] |
| 171 | A_23_P18325 | PDCD10 | CCAACCGACTAATTCATCAAACCAACTTAATACTTCAGACCTTCA AAACTGTGGCCTGAA | SEQ ID NO: 1039 | Homo sapiens programmed cell death 10 (PDCD10), transcript variant 1, mRNA [NM_007217] |
| 172 | A_23_P18422 | MRPL3 | CAGTACAAAACCATATGGGGACTATAGTGCAACCTATTTGGGTAA AGAAAACCATTTGGTA | SEQ ID NO: 1040 | Homo sapiens mitochondrial ribosomal protein L3 (MRPL3), nuclear gene encoding mitochondrial protein, mRNA [NM_007208] |
| 173 | A_23_P18598 | PI4K2B | AGGCTTAAAACCAATGTAACTAGAAGTAACTTGTGACAACCTCAGTTG TGGTCTAGGCCTTT | SEQ ID NO: 1041 | Homo sapiens phosphatidylinositol 4-kinase type 2 beta (PI4K2B), mRNA [NM_018323] |
| 174 | A_23_P200030 | FPGT | TAAAAATTGGTAAACTAGAAGTAACTGTCACAACCCTCAGTTA TGATACGTTATGTGCG | SEQ ID NO: 1042 | Homo sapiens fucose-1-phosphate guanylyltransferase (FPGT), mRNA [NM_003838] |

Fig. 3-10

| No. | Probe ID No. | Symbols of genes | Sequence | SEQ ID NO: | Descriptions of genes (letters and numbers within [ ] indicates GenBank accession No.) |
|---|---|---|---|---|---|
| 175 | A_23_P200298 | AGL | TAGATTTTAACAGGTGTCATTTGAGTAAACGTTTCGGTAGAATGCTTCATAGCTTGAGTG | SEQ ID NO:1043 | Homo sapiens amylo-1, 6-glucosidase, 4-alpha-glucanotransferase (glycogen debranching enzyme, glycogen storage disease type III) (AGL), transcript variant 4, mRNA [NM_000028] |
| 176 | A_23_P200493 | LBR | GAGCCCATTTATCAATACAGTGCTGCAATTCTCTGGATATGAGCTACAGTTGTTTTAAGT | SEQ ID NO:1044 | Homo sapiens lamin B receptor (LBR), transcript variant 1, mRNA [NM_002296] |
| 177 | A_23_P200507 | CNIH4 | TGGATTGAAGTCAGGCAGCACACTGGACAGTTGAGGAGCCAGAGACTGTTAAATCAT | SEQ ID NO:1045 | Homo sapiens cornichon homolog 4 (Drosophila) (CNIH4), mRNA [NM_014184] |
| 178 | A_23_P200955 | A_23_P200955 | AGAGCATGATTGAAGCTGAGATTGATGTCAAGACTACCGATGGTTATTGTTTCATCTAC | SEQ ID NO:1046 | |
| 179 | A_23_P201519 | NEK7 | TGAAGGCAAAGAAGTCACTGTTAAAGGACTGTGTGGCATCGTACAACCTGGATGAA | SEQ ID NO:1047 | Serine/threonine-protein kinase Nek7 (EC 2.7.11.1) (NimA-related protein kinase 7). [Source:Uniprot/SWISSPROT:Acc:Q8TDX7] [ENST00000367385] |
| 180 | A_23_P201918 | ABCB10 | CATGCATGAGGCTAGACCCTAAGAGAAGTAATTAAGTCAATGTAAATCAAATGGAAGTTTTC | SEQ ID NO:1048 | Homo sapiens ATP-binding cassette, sub-family B (MDR/TAP), member 10 (ABCB10), nuclear gene encoding mitochondrial protein, mRNA [NM_012089] |
| 181 | A_23_P201951 | ARID4B | ATGTTTACAGGTTTGAATTAGGCTAAAAGGTCTTGCAGTGGCTTTTCATGGGCCTTCAAA | SEQ ID NO:1049 | Homo sapiens AT rich interactive domain 4B (RBP1-like) (ARID4B), transcript variant 1, mRNA [NM_016374] |
| 182 | A_23_P20225 | RRM2B | TGCTCCTTTGTAAAAGATTTGAAAGAGAATCTCATATCCCGAGGCATTAGGA | SEQ ID NO:1050 | Homo sapiens ribonucleotide reductase M2 B (TP53 inducible) (RRM2B), mRNA [NM_015713] |
| 183 | A_23_P202496 | NOC3L | ACAGCTTGCACTATTCTAGGAGTGGCTAAGAAATGCGTGTTCAGTGACTAGATAT | SEQ ID NO:1051 | Homo sapiens nucleolar complex associated 3 homolog (S. cerevisiae) (NOC3L), mRNA [NM_022451] |
| 184 | A_23_P202637 | SAPS3 | TGATTATTCCTACAAGTGGAAACAGTAGACTATTTGGAGTGTATATGGCTGTGTTTTGGG | SEQ ID NO:1052 | Homo sapiens SAPS domain family, member 3 (SAPS3), mRNA [NM_018312] |
| 185 | A_23_P203498 | TRIM22 | GTAGATAAGAATCTATCACTAAGTAATGTATGTCTTCAGAATGTGTTGGTTTACCAGTGAC | SEQ ID NO:1053 | Homo sapiens tripartite motif-containing 22 (TRIM22), mRNA [NM_006074] |
| 186 | A_23_P203645 | CREBZF | TCTGTTGAGATATTTTCTTCCTTACGTCAATACTTTCCTGCATTATTTGAAATTGTGGG | SEQ ID NO:1054 | Homo sapiens CREB/ATF bZIP transcription factor (CREBZF), mRNA [NM_001039618] |
| 187 | A_23_P204187 | FLJ22028 | CTATAAGCTTGCTACTGCTGTGGGAAAATACAATGCACAGAGCGCTTAGGTTCAGATCATGAATT | SEQ ID NO:1055 | Homo sapiens hypothetical protein FLJ22028 (FLJ22028), mRNA [NM_024854] |
| 188 | A_23_P204269 | USP15 | GACCAGGATAAATGAGGTATGTTGATCATGAGGTTTGGTTTTATATCTTGATATTAAAGCTG | SEQ ID NO:1056 | Homo sapiens ubiquitin specific peptidase 15 (USP15), mRNA [NM_006313] |
| 189 | A_23_P204564 | PPP1R12A | GTATAAGATGTTAGATCTGTGTAATCTCACATTCATTTTAGCAGGTACTGAGTGATGCTG | SEQ ID NO:1057 | Homo sapiens protein phosphatase 1, regulatory (inhibitor) subunit 12A (PPP1R12A), mRNA [NM_002480] |
| 190 | A_23_P205027 | ABHD13 | ATTTGTGCAGAATGATAAGAATGTTCCTTTTAGAAGTGTGTTATGTCGTACCTGTCTG | SEQ ID NO:1058 | Homo sapiens abhydrolase domain containing 13 (ABHD13), mRNA [NM_032859] |
| 191 | A_23_P205336 | C14orf129 | CAATTCATTGCCAGACTTCATTGGAATGCTTTGTTTGATGATGTATGTTCATTCTCAGCT | SEQ ID NO:1059 | Homo sapiens chromosome 14 open reading frame 129 (C14orf129), mRNA [NM_016472] |

Fig. 3-11

| No. | Probe ID No. | Symbols of genes | Sequence | SEQ ID NO: | Descriptions of genes (letters and numbers within [ ] indicate GenBank accession No.) |
|---|---|---|---|---|---|
| 192 | A_23_P205645 | MAP4K5 | GTAATGCTAGCAGGGGGAAGTATTTAATTGCCCATGATATGTATTT TACTTATACTATGCC | SEQ ID NO: 1060 | Homo sapiens mitogen-activated protein kinase kinase kinase kinase 5 (MAP4K5), transcript variant 2, mRNA [NM_198794] |
| 193 | A_23_P20606 | NIPSNAP3A | GTAAGTACGACTTCAAAAAATAGTTCTGTTTACTTCTGTTTGCATGGT ATTTCAGTGTGTGTC | SEQ ID NO: 1061 | Homo sapiens nipsnap homolog 3A (C. elegans) (NIPSNAP3A), mRNA [NM_015469] |
| 194 | A_23_P207288 | LOC51136 | CCAAAACAGCAATTTGAAATTAGAACTAGTGGTTTTAGAGAAGTC AGGTATTCTTCCTG | SEQ ID NO: 1062 | Homo sapiens PTD016 protein (LOC51136), mRNA [NM_016125] |
| 195 | A_23_P207999 | PMAIP1 | TTAGAGAATCGTTCTAGTGTTTTTGCCGAAGATTACCGCTGGCT ACTGTGAAGGGAGAT | SEQ ID NO: 1063 | Homo sapiens phorbol-12-myristate-13-acetate-induced protein 1 (PMAIP1), mRNA [NM_021127] |
| 196 | A_23_P208238 | ZNF137 | CCATACTGGACATAAAATCTTAAGTGTCTTAAGTGTGGCAAGGT CTTCAGTGTGTGGGC | SEQ ID NO: 1064 | Homo sapiens zinc finger protein 137 (ZNF137), mRNA [NM_003438] |
| 197 | A_23_P209032 | ZNF302 | TCAGAAAAATGTATCTGGGGAAAAGTTGTATGAAGGTGGTGAAC ATGGAGAGCTTTAG | SEQ ID NO: 1065 | Homo sapiens zinc finger protein 302 (ZNF302), transcript variant 1, mRNA [NM_018443] |
| 198 | A_23_P209879 | ATF2 | TCATGTAAACGGTTAACAAGCTTACCAAGGTTAGCAAAACTTCA TTGTAAATCAGTCTG | SEQ ID NO: 1066 | Homo sapiens cDNA FLJ46899 fis, clone UTERU3022588, highly similar to Cyclic-AMP-dependent transcription factor ATF-2. [AK128731] |
| 199 | A_23_P210274 | PREI3 | GGATCAGTATGCCGTAGGATTTAGAGAATAATATTTCAACATGCTAT TTCATCACTCGGCAG | SEQ ID NO: 1067 | Homo sapiens preimplantation protein 3 (PREI3), transcript variant 1, mRNA [NM_015387] |
| 200 | A_23_P210829 | PCMTD2 | TCCTGCGGCACCTTATACCAGAATTCAGTATATAATACACTACTTCT GTTTCAAACAGATA | SEQ ID NO: 1068 | Homo sapiens protein-L-isoaspartate (D-aspartate) O-methyltransferase domain containing 2 (PCMTD2), mRNA [NM_018257] |
| 201 | A_23_P211840 | UBE1C | GCCACACCCTAGAGCGAAAAAATAGAACACACTTACTTACGATCGGTA ACCTCTATTGAAGAA | SEQ ID NO: 1069 | Homo sapiens ubiquitin-activating enzyme E1C (UBA3 homolog, yeast) (UBE1C), transcript variant 1, mRNA [NM_003968] |
| 202 | A_23_P212728 | TBC1D23 | TGTACCCTGTTAACGACCAGTCATTCATTTTGATTTAGTTATGGAAATC AAGTGAATAAAAGGC | SEQ ID NO: 1070 | Homo sapiens TBC1 domain family, member 23, mRNA (cDNA clone MGC:8800 IMAGE:3847561), complete cds. [BC020955] |
| 203 | A_23_P2129 | TMEM126B | CATATGCATCATTGGCTGCACACTTCGATTTTTGTGTAGTGTTGTTA CTGCAAAGCTTTTG | SEQ ID NO: 1071 | Homo sapiens transmembrane protein 126B (TMEM126B), mRNA [NM_018480] |
| 204 | A_23_P213661 | HISPPD1 | GTATGTAAGTTTCTGTTTGTGAAAATGTAGTAATGTACTGACT GTGGAGGTCATAAGG | SEQ ID NO: 1072 | Homo sapiens histidine acid phosphatase domain containing 1 (HISPPD1), mRNA [NM_015216] |
| 205 | A_23_P215751 | NDUFA5 | TAAAAGTGGAGTCACTAAATAGTTTGCAGTACGTTTCTATATAA GTGTAGGTGGGTATC | SEQ ID NO: 1073 | Homo sapiens NADH dehydrogenase (ubiquinone) 1 alpha subcomplex, 5, 13kDa (NDUFA5), nuclear gene encoding mitochondrial protein, mRNA [NM_005000] |
| 206 | A_23_P21734 | TAF9 | CATGGTTGTGATTTCTTCCGTGAACGCGTGGTTTCATATAGTTTT GTGCTGAGAACAGAT | SEQ ID NO: 1074 | Homo sapiens TAF9 RNA polymerase II, TATA box binding protein (TBP)-associated factor, 32kDa (TAF9), transcript variant 3, mRNA [NM_001015891] |
| 207 | A_23_P217384 | AP1S2 | AAACGTTGCTCTCTCTTCACAGTATTATGTGTAAAAGTCATTGTTT AAAGCACGAATGTTC | SEQ ID NO: 1075 | Homo sapiens adaptor-related protein complex 1, sigma 2 subunit (AP1S2), mRNA [NM_003916] |
| 208 | A_23_P217564 | ACSL4 | GTTATAGGTCGTTAGAAACACATAATTAACACTTAAGGTTGGGT CGTGCTAATTGTTTG | SEQ ID NO: 1076 | Homo sapiens acyl-CoA synthetase long-chain family member 4 (ACSL4), transcript variant 1, mRNA [NM_004458] |

Fig. 3-12

| No. | Probe ID No. | Symbols of genes | Sequence | SEQ ID NO: | Descriptions of genes (letters and numbers within [ ] indicates GenBank accession No.) |
|---|---|---|---|---|---|
| 209 | A_23_P218928 | C4orf18 | CAGATGAGTTCATTTGCTTCTCTAGATGTGTTTTCAAGAGCTAGGTACAGACGAATGTTTG | SEQ ID NO: 1077 | Homo sapiens chromosome 4 open reading frame 18 (C4orf18), transcript variant 2, mRNA [NM_016613] |
| 210 | A_23_P219072 | SAMD9 | AACCTACGCTCCAAGATTAGTAAAGCCAGTTGAAAAACTAAAAGATCAGCCTCGGAGAAGTCT | SEQ ID NO: 1078 | Homo sapiens sterile alpha motif domain containing 9 (SAMD9), mRNA [NM_017654] |
| 211 | A_23_P22671 | SYBL1 | CAAACGGAATACGGTCAGCAGTGCAAACTCGAAGGGTTTGGGCTTGATTCCTGTTGAATAATA | SEQ ID NO: 1079 | Homo sapiens synaptobrevin-like 1 (SYBL1), mRNA [NM_005638] |
| 212 | A_23_P23765 | ITGB3BP | AGTATACAGGCTTGGAGGGCAGTAGAGAGCTTGAAAATCTCATTGGAATCTCCGTGTGCA | SEQ ID NO: 1080 | Homo sapiens integrin beta 3 binding protein (beta3-endonexin) (ITGB3BP), mRNA [NM_014288] |
| 213 | A_23_P23960 | BLOC1S2 | GAGTAAAGTGGAGGACTGTGGGTATTCCTGAACCTTCTTTGAGAGAGAATCCCTCAGAAT | SEQ ID NO: 1081 | Homo sapiens biogenesis of lysosome-related organelles complex-1, subunit 2 (BLOC1S2), transcript variant 2, mRNA [NM_001001342] |
| 214 | A_23_P24365 | ANKRD49 | GGGCACTGGTTGTATAGTCTCTCAAGTTCAGAGGAAATGTTGATTTTCTAAGGTCCTCAT | SEQ ID NO: 1082 | Homo sapiens ankyrin repeat domain 49 (ANKRD49), mRNA [NM_017704] |
| 215 | A_23_P250002 | HACE1 | TAAGCAGTCATTGTGTTTGCCAGTAATGTTTGAGAGACATGTAAGTTGAAAGTTTTGCTA | SEQ ID NO: 1083 | Homo sapiens HECT domain and ankyrin repeat containing, E3 ubiquitin protein ligase 1 (HACE1), mRNA [NM_020771] |
| 216 | A_23_P250800 | ST3GAL6 | ATGTCACGAAGTTCACCTAGCTGGTTTTAAATACAACTTTTCTGACCTCAAGAGTCCTT | SEQ ID NO: 1084 | Homo sapiens ST3 beta-galactoside alpha-2,3-sialyltransferase 6 (ST3GAL6), mRNA [NM_006100] |
| 217 | A_23_P250930 | CRBN | TGATGTATTGAGGAATTCAGGCTGCTTAAAATTGGCAGTGCTGCTATCCAGCGAGTTGGCTGTGA | SEQ ID NO: 1085 | Homo sapiens cereblon (CRBN), mRNA [NM_016302] |
| 218 | A_23_P250994 | ANAPC10 | GATTCATTGTCCTTACGTAACATGACAATGCATAAGAAGCCAACTCGTAGATTCCATATACAGAT | SEQ ID NO: 1086 | Homo sapiens anaphase promoting complex subunit 10 (ANAPC10), mRNA [NM_014885] |
| 219 | A_23_P251421 | CDCA7 | ATTTACTTGCATATGTAAACCATTGGTGTGCCATTGAATGTTGATGGAATAATTGGAACCT | SEQ ID NO: 1087 | Homo sapiens cell division cycle associated 7 (CDCA7), transcript variant 1, mRNA [NM_031942] |
| 220 | A_23_P251937 | CPEB4 | GTATGTCAGTTAATTGTACTACTTGGCTGAATTTCCATATAGTTTTACTGTGTATGGGG | SEQ ID NO: 1088 | Homo sapiens cytoplasmic polyadenylation element binding protein 4 (CPEB4), mRNA [NM_030627] |
| 221 | A_23_P252145 | C1GALT1 | ATATGTCTATATATATGAGGGAACTTGTGTTTTTAAATGGTGGCCAGGTAGAGGAACTAG | SEQ ID NO: 1089 | Homo sapiens core 1 synthase, glycoprotein-N-acetylgalactosamine 3-beta-galactosyltransferase, 1 (C1GALT1), mRNA [NM_020156] |
| 222 | A_23_P252201 | EAF2 | CAGGATTCCTGATATAGATGCCAGTCATAATAGATTTCGGAGACAACAGTGGCCTTCTGAT | SEQ ID NO: 1090 | Homo sapiens ELL associated factor 2 (EAF2), mRNA [NM_016456] |
| 223 | A_23_P252371 | RBBP8 | GGGAAGGGAGGAGAGAAGACATAGACGTTGAAACAGAAACAGAAGGATGAAGGACAGTTTTT | SEQ ID NO: 1091 | Homo sapiens retinoblastoma binding protein 8 (RBBP8), transcript variant 1, mRNA [NM_002894] |
| 224 | A_23_P253412 | MRPL50 | GAAAAGTTTTGAGAGGGACTGTCAACTTGGGTTAAGACAGAGGACATTGCAAGTTGA | SEQ ID NO: 1092 | Homo sapiens mitochondrial ribosomal protein L50 (MRPL50), nuclear gene encoding mitochondrial protein, mRNA [NM_019051] |
| 225 | A_23_P254472 | C6orf211 | TTCATTCAATAGGTTGTTTCATTTGACACGCCTTGTATTTGATTGAACTTGTAGAATGG | SEQ ID NO: 1093 | Homo sapiens chromosome 6 open reading frame 211 (C6orf211), mRNA [NM_024573] |
| 226 | A_23_P254702 | DEK | TTTTTTATTAACTGCTTTTTGCCATATAACATGCTGATATTTAGTGGAAACCTAGCCAGC | SEQ ID NO: 1094 | Homo sapiens DEK oncogene (DNA binding) (DEK), mRNA [NM_003472] |
| 227 | A_23_P254733 | MLF1IP | GCTGTTACCTTCTGAAACGTACCTTTATAAATCAATTGTTTTGCAAAGAAGTTATGGGC | SEQ ID NO: 1095 | Homo sapiens MLF1 interacting protein (MLF1IP), mRNA [NM_024629] |

Fig. 3-13

| No. | Probe ID No. | Symbols of genes | Sequence | SEQ ID NO: | Descriptions of genes (letters and numbers within [ ] indicates GenBank accession No.) |
|---|---|---|---|---|---|
| 228 | A_23_P264756 | CD164 | TTAGTTTTAGTGAGTGCTGTAGGATTAATTCGAAAATAGGGAGAATTCGAATGGTCCCA | SEQ ID NO: 1096 | Homo sapiens CD164 molecule, sialomucin (CD164), mRNA [NM_006016] |
| 229 | A_23_P25503 | FNDC3A | ATACTGCCATTTGAGCCTCACTGCAAAATTAGTGCAGAGGAGAAAACGAATTTTAATGT | SEQ ID NO: 1097 | Homo sapiens fibronectin type III domain containing 3A (FNDC3A), transcript variant 2, mRNA [NM_014923] |
| 230 | A_23_P255663 | MANEA | AAAGAGTCGTACATCTTCAGAGTTTCAGTCGGGAATTTCTTGGCCATGGATGTAGAACC | SEQ ID NO: 1098 | Homo sapiens mannosidase, endo-alpha (MANEA), mRNA [NM_024641] |
| 231 | A_23_P256231 | FBXO30 | GGCTTTTAAAGTTTTGCTGAAGAATGTGTCGTGGTTAGGATAGCACAAGAATAACTT | SEQ ID NO: 1099 | Homo sapiens F-box protein 30 (FBXO30), mRNA [NM_032145] |
| 232 | A_23_P256342 | SNX13 | ATTAGGCAGGTGATGATCCTTGAAACATCTTCAGGTGTCGAGAAAGAGAAGAATG | SEQ ID NO: 1100 | Homo sapiens sorting nexin 13 (SNX13), mRNA [NM_015132] |
| 233 | A_23_P25638 | C13orf7 | CTTGCATTCCAGGGGAGTTTCTTTGAGTAGTATGTTCTTGTTTGCATGTCCTGTTG | SEQ ID NO: 1101 | Homo sapiens chromosome 13 open reading frame 7 (C13orf7), mRNA [NM_024546] |
| 234 | A_23_P25735 | PSMA6 | TAGCAGAGAGAGACTAAACATTGTCGTTAGTTACCAGATCGGTGATGCAACTTACCTGT | SEQ ID NO: 1102 | Homo sapiens proteasome (prosome, macropain) subunit, alpha type, 6 (PSMA6), mRNA [NM_002791] |
| 235 | A_23_P257911 | USP16 | GTACTTTGTGTTTAATATCTGGGTGATGGATCACAACATGAATAAACTGACTTACC | SEQ ID NO: 1103 | Homo sapiens ubiquitin specific peptidase 16 (USP16), transcript variant 1, mRNA [NM_006447] |
| 236 | A_23_P258108 | LOC731224 | GTGAGCCCAGGTGTTGCTTGTTGAATATGCCAAGCCAGAAAGATGAGTCATCGTAAA | SEQ ID NO: 1104 | PREDICTED: Homo sapiens similar to 60S ribosomal protein L9 (LOC731224), mRNA [XR_015767] |
| 237 | A_23_P259054 | SNX14 | CATCAGACTCGTGTTTGATCGGCTTACAGACAGCAGCTACTCAACGAGCAGGCTGACTTATGT | SEQ ID NO: 1105 | Homo sapiens sorting nexin 14 (SNX14), transcript variant 1, mRNA [NM_153816] |
| 238 | A_23_P259594 | AKAP7 | GAAGATAAGCTCCAGGTCTTATCGTATCCCTTGCCATCTGAACTTGTTTGCACTGCTCT | SEQ ID NO: 1106 | Homo sapiens A kinase (PRKA) anchor protein 7 (AKAP7), transcript variant gamma, mRNA [NM_016377] |
| 239 | A_23_P26021 | COPS2 | TGCTTTTTGATCAAGCTGGTTTGTGTTTGCTGCTGCATTATCCCAAGAAAAACAGCTT | SEQ ID NO: 1107 | Homo sapiens COP9 constitutive photomorphogenic homolog subunit 2 (Arabidopsis) (COPS2), mRNA [NM_004236] |
| 240 | A_23_P2705 | P2RY5 | TCTGTGTATTGCTGTTCCAAGCTGTTGTTTTGACCCTATAGTTTACTACTTTACATCGGACA | SEQ ID NO: 1108 | Homo sapiens purinergic receptor P2Y, G-protein coupled, 5 (P2RY5), mRNA [NM_005767] |
| 241 | A_23_P28169 | ARL6IP6 | GGAAAGGAAATAATAGCCTACTACTGCCACTTTATAGAAGCTACTTTAAATCAGAATAT | SEQ ID NO: 1109 | Homo sapiens ADP-ribosylation-like factor 6 interacting protein 6 (ARL6IP6), mRNA [NM_152522] |
| 242 | A_23_P29005 | SAMSN1 | CTCTTGGTTGCTATATCTCATCAGGAAAATTCAGATAATGGCAAAGAGGATCTGAGTCTGA | SEQ ID NO: 1110 | Homo sapiens SAM domain, SH3 domain and nuclear localization signals 1 (SAMSN1), mRNA [NM_022136] |
| 243 | A_23_P302550 | RGS18 | GAGTCTAAGGCCCTAGGCATTTGGGCATCTGCCAACATTGGTTCATATTCAGAAAGTGTTA | SEQ ID NO: 1111 | Homo sapiens regulator of G-protein signalling 18 (RGS18), mRNA [NM_130782] |
| 244 | A_23_P30307 | CRSP9 | CAATTGTACTGGACAGAATGAACATCAAAGAGAAAATTCAGGTCATAGGAGAGATCAGAT | SEQ ID NO: 1112 | Homo sapiens cofactor required for Sp1 transcriptional activation, subunit 9, 33kDa (CRSP9), mRNA [NM_004270] |
| 245 | A_23_P303260 | STX7 | GTCTGATGTTTACGGGGACGAGTGTAGTTACTAACATGTTTAACATAATTTGGAAGAAG | SEQ ID NO: 1113 | Homo sapiens syntaxin 7 (STX7), mRNA [NM_003569] |
| 246 | A_23_P305060 | PBEF1 | TGCCTGTGGCTCTATATGCACCTCAAGATTTAAGGAGATAATGTTTTTAAGAGAATT | SEQ ID NO: 1114 | Homo sapiens pre-B-cell colony enhancing factor 1 (PBEF1), mRNA [NM_005746] |

Fig. 3-14

| No. | Probe ID No. | Symbols of genes | Sequence | SEQ ID NO: | Descriptions of genes (letters and numbers within [ ] indicates GenBank accession No.) |
|---|---|---|---|---|---|
| 247 | A_23_P305723 | MIER1 | TGATGTATTTTCAAATACAGTTCAGGATCTGAGAATTCAGTTGAAC ACAAGTTTGTTGAGC | SEQ ID NO: 1115 | Homo sapiens mesoderm induction early response 1 homolog (Xenopus laevis) (MIER1), transcript variant 1, mRNA [NM_020948] |
| 248 | A_23_P306890 | POLI | TCAATAACGGAGTAAACTGTTCAGATAAAGCAAGAATAGTTGCA ACAAGTAAATCTCGG | SEQ ID NO: 1116 | Homo sapiens polymerase (DNA directed) iota (POLI), mRNA [NM_007195] |
| 249 | A_23_P307940 | CAPZA2 | CTACAAGATTGGCAAGAAGAGATGCAAGAATGCATAAGATGAACATTG CATGACCGGATCATT | SEQ ID NO: 1117 | Homo sapiens capping protein (actin filament) muscle Z-line, alpha 2 (CAPZA2), mRNA [NM_006136] |
| 250 | A_23_P308600 | GLS | CGGAAGAAGATAAGAATACTGCGGAATAGCGCCTCAAAGTTAAAA AAGAAAAAACTTTGC | SEQ ID NO: 1118 | Homo sapiens glutaminase C mRNA, complete cds. [AF158555] |
| 251 | A_23_P30956 | KIAA0776 | TTTTTCATTTGTCAAATGCTCTTTTGTTGCCACAGTAAAGAA CAGTTTTTATTGTTT | SEQ ID NO: 1119 | Homo sapiens KIAA0776 (KIAA0776), mRNA [NM_015293] |
| 252 | A_23_P31097 | OSTM1 | ACTGAAAATGTGCTGGGGTTTGTTGCTGTCACTGTTTATGGTG CTGGAACTTAGCACT | SEQ ID NO: 1120 | Homo sapiens osteopetrosis associated transmembrane protein 1 (OSTM1), mRNA [NM_014028] |
| 253 | A_23_P312246 | CCDC82 | GGCTTTATAACGATGACTGTCAAGTGAATGAAGTGTTGATATCC TGTCAGTTTAGTCAA | SEQ ID NO: 1121 | Homo sapiens coiled-coil domain containing 82 (CCDC82), mRNA [NM_024725] |
| 254 | A_23_P314191 | ZDHHC17 | TGGACTCTTTAGCAAATAAGGAACTAATTCTCAGCACTGAACAT GAATTACTTCCTTGG | SEQ ID NO: 1122 | Homo sapiens zinc finger, DHHC-type containing 17 (ZDHHC17), mRNA [NM_015336] |
| 255 | A_23_P314591 | NFYB | GGAGGCATTTACTAAGCAGTTACCAGCTGGGCTTAATAACCACAGA CGGTCAACAACAAAA | SEQ ID NO: 1123 | Homo sapiens nuclear transcription factor Y, beta (NFYB), mRNA [NM_006166] |
| 256 | A_23_P31671 | UQCRB | AAGCCATAAGAGAGACTTCCTGAGAACGTTTATAATGACAGAGATGT TTCGGCATTAAGAGGG | SEQ ID NO: 1124 | Homo sapiens ubiquinol-cytochrome c reductase binding protein (UQCRB), mRNA [NM_006294] |
| 257 | A_23_P31702 | PXMP3 | CTTCTCTGGCATGGTTTTGGTGAATTTCTGATTTTTCTCTTACCA CTTATCAATGTCCAG | SEQ ID NO: 1125 | Homo sapiens peroxisomal membrane protein 3, 35kDa (Zellweger syndrome) (PXMP3), transcript variant 1, mRNA [NM_000318] |
| 258 | A_23_P317347 | ESCO1 | GCTAATTTTTAAAAGGCCTGAACTATAGTTTGAAGAAAGCGGCTAT AGAAAAGGAAAGCTC | SEQ ID NO: 1126 | Homo sapiens establishment of cohesion 1 homolog 1 (S. cerevisiae) (ESCO1), mRNA [NM_052911] |
| 259 | A_23_P3204 | MAPK6 | AACGTGCTCACTGTGTATAGGAATTGTATTTGGAGGTGCTTGA TGTATGTACAAAGAA | SEQ ID NO: 1127 | Homo sapiens mitogen-activated protein kinase 6 (MAPK6), mRNA [NM_002748] |
| 260 | A_23_P324633 | C9orf72 | TTTGTTGGATTTAGTCCCTGGGATTCAGTCTGTGTAGAAATGTCTAAT AGTTCTCTATAGTCG | SEQ ID NO: 1128 | Homo sapiens chromosome 9 open reading frame 72 (C9orf72), transcript variant 1, mRNA [NM_018325] |
| 261 | A_23_P325501 | MORC3 | CATGCATAAAATACTATATGCTTATTGGTCCCATGTTTTGTGCAA TTTTAAAGAGATGGC | SEQ ID NO: 1129 | Homo sapiens MORC family CW-type zinc finger 3 (MORC3), mRNA [NM_015358] |
| 262 | A_23_P327022 | MDFIC | TTATGATTCTTAATGTAAATGTTTTTGAAGTATAGGCTAT CATGACTAAGTGCTA | SEQ ID NO: 1130 | Homo sapiens MyoD family inhibitor domain containing (MDFIC), mRNA [NM_199072] |
| 263 | A_23_P329198 | OBFC2A | ACATGTCATAAGTGTACGGCACTTCCCCTTTTTACTGTAGGGTGG ATAAGTCTTAGGATT | SEQ ID NO: 1131 | Homo sapiens oligonucleotide/oligosaccharide-binding fold containing 2A (OBFC2A), mRNA [NM_001031716] |
| 264 | A_23_P33045 | RPL26 | TACAAAGGTCAGCAAATTGGCAAAGTAGTAGTCAAGGTTTTACAGAAG AAATATGTTATCTAC | SEQ ID NO: 1132 | Homo sapiens ribosomal protein L26 (RPL26), mRNA [NM_000987] |
| 265 | A_23_P332439 | NUPL1 | ATTGAAATCTTGAATGTATTGAATCTGTCAAGGTACACAGCGGGTG CCTTTGTAAATGTTC | SEQ ID NO: 1133 | Homo sapiens KIAA0410 mRNA, partial cds. [AB007870] |
| 266 | A_23_P339480 | HAT1 | AACATGAACAGCTGGAAGAGAGTTTCAGGAACTAGTGAAGATT ACCGGCGGTGTTATTG | SEQ ID NO: 1134 | Homo sapiens histone acetyltransferase 1 (HAT1), transcript variant 1, mRNA [NM_003642] |

Fig. 3-15

| No. | Probe ID No. | Symbols of genes | Sequence | SEQ ID NO: | Descriptions of genes (letters and numbers within [ ] indicates GenBank accession No.) |
|---|---|---|---|---|---|
| 267 | A_23_P34307 | PIGK | ATTCATTTCAGAGTCTTCTATTGTTGGACCAGTTACATTGTACCA AATGTTTTCCTTTGG | SEQ ID NO: 1135 | Homo sapiens phosphatidylinositol glycan anchor biosynthesis, class K (PIGK), mRNA [NM_005482] |
| 268 | A_23_P247059 | MOBKL1A | CTAGAAGGGGAAAAATCATGTAAGTTATGAAATCAACATAGGCG CTATATTAGAAACTG | SEQ ID NO: 1136 | Homo sapiens MOB1, Mps One Binder kinase activator-like 1A (yeast) (MOBKL1A), mRNA [NM_173468] |
| 269 | A_23_P247198 | SP3 | GACCACGTCAAATTTAAAGGGTAGGTTATTGTACGTTAAAGTGT ATTATAACAGTGTGG | SEQ ID NO: 1137 | Homo sapiens Sp3 transcription factor (SP3), transcript variant 1, mRNA [NM_003111] |
| 270 | A_23_P249083 | FCHO2 | GTGAAATGGTTAAACTTGTGCACTTTGTGTAGTTACCACAGTGTTC ATACCAAGTATTGGG | SEQ ID NO: 1138 | Homo sapiens FCH domain only 2 (FCHO2), mRNA [NM_138782] |
| 271 | A_23_P251467 | CMAH | GCTTACATTTGTGGATCACTACACATAGCCAGAATCAAAAATATTTT AGTTGTTCGATCGAC | SEQ ID NO: 1139 | Homo sapiens cytidine monophosphate-N-acetylneuraminic acid hydroxylase (CMP-N-acetylneuraminate monooxygenase) (CMAH) on chromosome 6 [NR_002174] |
| 272 | A_23_P253704 | RP5-1022P6.2 | TGTCTCTCACTACGTATTACACACTGTGTTGGTTGTGGGTTTGTTT TGTATGTCGGTGTGT | SEQ ID NO: 1140 | Homo sapiens hypothetical protein KIAA1434 (KIAA1434), mRNA [NM_019593] |
| 273 | A_23_P254094 | ZNF567 | ACCTAAGAGTTACCACCTCGGTAGGCTATAACATCAAAAGTAGT TTTTGCATGTTTCA | SEQ ID NO: 1141 | Homo sapiens zinc finger protein 567 (ZNF567), mRNA [NM_152603] |
| 274 | A_23_P255067 | TMCO1 | AACTCAAGAACTCTTTATTTCTATCATTGTTCTCAGAGACACAC ACATCAGACTTGGCAA | SEQ ID NO: 1142 | Homo sapiens transmembrane and coiled-coil domains 1 (TMCO1), mRNA [NM_019026] |
| 275 | A_23_P255244 | SAMD9 | TCAGTGGAGGAAGATTTTCCCTTGCTTCTGCATAAAATTTTAACT CCATAACTTATAAGC | SEQ ID NO: 1143 | Homo sapiens sterile alpha motif domain containing 9 (SAMD9), mRNA [NM_017654] |
| 276 | A_23_P256122 | ZNF451 | TTTTACCTGCTTAGATCCTTTTAATTACTGCTGTGTATATTTGTTGATTTTGGAGTTA AAAGGGAATGGTGTC | SEQ ID NO: 1144 | Homo sapiens zinc finger protein 451 (ZNF451), transcript variant 2, mRNA [NM_015555] |
| 277 | A_23_P256125 | KIAA1468 | GCACTGCTTTAATTACTGGTGTATATTTGTTGATTTTGGAGTTA CAACTGTGGTGATAG | SEQ ID NO: 1145 | Homo sapiens KIAA1468 (KIAA1468), mRNA [NM_020854] |
| 278 | A_23_P257811 | MBNL1 | ATCGTTTCAAACCTGCATGACTGACTGAACAAAAACTCGATGGGAGCCAAA TCTGCCTGAAGATCA | SEQ ID NO: 1146 | Homo sapiens muscleblind-like (Drosophila) (MBNL1), transcript variant 1, mRNA [NM_021038] |
| 279 | A_23_P258470 | CCDC111 | ATGACCCTGTATGTAAGGACAGAAGAAAACTTCAAATCTGACTGTTCC CATTACCTGCTGAAG | SEQ ID NO: 1147 | Homo sapiens coiled-coil domain containing 111 (CCDC111), mRNA [NM_152683] |
| 280 | A_23_P264107 | C14orf106 | AGGAGAGAGTGTTGTATTTGTATTTTCAACTGGGAGTACATGTATTTTCTT TGTAAAGTAGGTTGC | SEQ ID NO: 1148 | Homo sapiens chromosome 14 open reading frame 106 (C14orf106), mRNA [NM_018353] |
| 281 | A_23_P36776 | PUS7L | GGGGCTTCAGTTTCAGATCTGTTCAAACATCGTGTAAAATGGGCATGTTAACATTGCC TACGTCATAGGATTA | SEQ ID NO: 1149 | Homo sapiens pseudouridylate synthase 7 homolog (S. cerevisiae)-like (PUS7L), mRNA [NM_031292] |
| 282 | A_23_P371266 | DNM3 | ACTGTCTTCTTGGCACTTCAGGATTTCTTAATGCTGATATATGG ACTCTTAGAATGGAA | SEQ ID NO: 1150 | Homo sapiens dynamin 3 (DNM3), mRNA [NM_015569] |
| 283 | A_23_P37275 | CGRRF1 | GAGGAAGATAAAGACAAACGAAGACTGTCTTGAAGACATCGTAAG ACTGAAAAGTAGACT | SEQ ID NO: 1151 | Homo sapiens cell growth regulator with ring finger domain 1 (CGRRF1), mRNA [NM_006568] |
| 284 | A_23_P37441 | B2M | TTGTCTTTCAGCAAGGACTGGTCTTCTATCGTGTTAGTACAGT GAATTCACGCCCGACT | SEQ ID NO: 1152 | Homo sapiens beta-2-microglobulin (B2M), mRNA [NM_004048] |
| 285 | A_23_P37636 | FAM96A | CTTGAACGTGACTGATAGGTCTGTTTTAAGAGCCACTGCCCTGTAAT TGTTTGATATATTG | SEQ ID NO: 1153 | Homo sapiens family with sequence similarity 96, member A (FAM96A), transcript variant 1, mRNA [NM_032231] |

Fig. 3-16

| No. | Probe ID No. | Symbols of genes | Sequence | SEQ ID NO: | Descriptions of genes (letters and numbers within [ ] indicates GenBank accession No.) |
|---|---|---|---|---|---|
| 286 | A_23_P38275 | THC2504576 | TCTCGGCAAAATGAAGTTTAATCCCTTGTGACTTCGGAGCGAAG CAAGAATCGGCAAAAG | SEQ ID NO: 1154 | RL26_BOVIN (P61257) 60S ribosomal protein L26, complete [THC2504576] |
| 287 | A_23_P384056 | CCDC14 | TAGCTCAGTATGATCATCTCCCTTCATGTAAGGACGACGTTTAACTC TTAGGAAGCTGAATG | SEQ ID NO: 1155 | Homo sapiens coiled-coil domain containing 14 (CCDC14), mRNA [NM_022757] |
| 288 | A_23_P390734 | FGFR1OP2 | CCAACGAGATACAGAAATGTGCTTTAACATCAGTTGAAAACCTAAAT TTTCTTATGTTGTGG | SEQ ID NO: 1156 | Homo sapiens FGFR1 oncogene partner 2 (FGFR1OP2), mRNA [NM_015633] |
| 289 | A_23_P394276 | RWDD4A | TTGTTCAGGCTTATTATGGCTCATAGATTACAGAGAATGATGCTA GTTACATGCCAATGA | SEQ ID NO: 1157 | Homo sapiens RWD domain containing 4A (RWDD4A), mRNA [NM_152682] |
| 290 | A_23_P394605 | SEC24A | GATTATTCTTCTAATCAAAGATGCATAACAGCTATTATCTAGG GGACCACCAAATGTG | SEQ ID NO: 1158 | Homo sapiens SEC24 related gene family, member A (S. cerevisiae) (SEC24A), mRNA [NM_021982] |
| 291 | A_23_P396353 | NIN | ATCTTCAGGTCTAGTATTTAATAATGACAGTATTAGCCAGGGGCA GATATTATGAGAAAC | SEQ ID NO: 1159 | Homo sapiens ninein (GSK3B interacting protein) (NIN), transcript variant 2, mRNA [NM_020921] |
| 292 | A_23_P399073 | PPM1B | GGTTCAGTAACTTTTCATTTTATACAATTGGGCACGGTACAGAGT GATTGTCAGATAAGG | SEQ ID NO: 1160 | Homo sapiens protein phosphatase 1B (formerly 2C), magnesium-dependent, beta isoform (PPM1B), transcript variant 2, mRNA [NM_177968] |
| 293 | A_23_P40059 | PMS1 | GATCCTCGTCTTACAGCGGAATGGTTCAAGATAAAATTGATACCA GGAGTTTCAATTACT | SEQ ID NO: 1161 | Homo sapiens PMS1 postmeiotic segregation increased 1 (S. cerevisiae) (PMS1), mRNA [NM_000534] |
| 294 | A_23_P405873 | C9orf72 | GAGGAATGGAAGATCAAGGTCAAGATATTATTCCAATGGTTACTGG AGAAGTGATTCCTGT | SEQ ID NO: 1162 | Homo sapiens chromosome 9 open reading frame 72 (C9orf72), transcript variant 2, mRNA [NM_145005] |
| 295 | A_23_P408455 | SLC25A36 | CCATTAACCTACAGACACTGATTTTTATGCTACTCCTTGTAGAAACA AAATTCTGGTTGAC | SEQ ID NO: 1163 | Homo sapiens mRNA; cDNA DKFZp564C053 (from clone DKFZp564C053). [AL049246] |
| 296 | A_23_P41114 | CSTA | AAACAAATGAGACGTTATGGAAGGTGTGCAGTATAAAA CTCAAGTGTTGCTC | SEQ ID NO: 1164 | Homo sapiens cystatin A (stefin A) (CSTA), mRNA [NM_005213] |
| 297 | A_23_P413796 | CCDC5 | GGATGGATGGCTTCTGTTCTGTCTCATCAGTCGCTTAGTAGGCACTACTACAG AGAAACTGGAAGAT | SEQ ID NO: 1165 | Homo sapiens coiled-coil domain containing 5 (spindle associated) (CCDC5), mRNA [NM_138443] |
| 298 | A_23_P41470 | FLJ20035 | TGTCGCTTAATGCTATAGCACTGATTTCTACAACATGGTTCCT TGATAGGATTAGTCC | SEQ ID NO: 1166 | Homo sapiens hypothetical protein FLJ20035 (FLJ20035), mRNA [NM_017631] |
| 299 | A_23_P41512 | C4orf15 | TAAGGCTGTTAGTCTTGAAGATTGAAGATTACTGAAAACTGAATC TTTATTACGTGTCCT | SEQ ID NO: 1167 | Homo sapiens chromosome 4 open reading frame 15 (C4orf15), mRNA [NM_024511] |
| 300 | A_23_P41645 | ELL2 | TGTCTTTTGAAAGTGCTGCCAGTTGAAAAGGGAAGCATTATGTTT ACAAATCTGTTTTGA | SEQ ID NO: 1168 | Homo sapiens elongation factor, RNA polymerase II, 2 (ELL2), mRNA [NM_012081] |
| 301 | A_23_P41664 | ENST00000334994 | TGGCTTGGAGCAGATTCGAGTTCATAACAAATTGTTCCTGAAAA TGAGGCACAGGTCAT | SEQ ID NO: 1169 | Synleurin (CGLQ1891). [Source:Uniprot/SPTREMBL;Acc:Q72Q07] [ENST00000334994] |
| 302 | A_23_P421583 | LSM3 | CATAAGAGAACCGTCCATACATTTTGATATTAAGAAATAATTCCC GGGATTCTTCGACTG | SEQ ID NO: 1170 | Homo sapiens LSM3 homolog, U6 small nuclear RNA associated (S. cerevisiae) (LSM3), mRNA [NM_014463] |
| 303 | A_23_P422083 | TMEM55A | AAATTTATGGAATCAGCTCGTCGGCACTGCCACTGCTTTGCAGTTTTG AAAAAGAAATTGGTT | SEQ ID NO: 1171 | Homo sapiens transmembrane protein 55A (TMEM55A), mRNA [NM_018710] |
| 304 | A_23_P422794 | NSMCE2 | CATTGTTCGGATGATTGAGTCCAAGGTCAAGGCAAAAGCGGAAGAAAAAGGC CTATTGCCCTCAAAT | SEQ ID NO: 1172 | Homo sapiens non-SMC element 2, MMS21 homolog (S. cerevisiae) (NSMCE2), mRNA [NM_173685] |

Fig. 3-17

| No. | Probe ID No. | Symbols of genes | Sequence | SEQ ID NO: | Descriptions of genes (letters and numbers within [ ] indicates GenBank accession No.) |
|---|---|---|---|---|---|
| 305 | A_23_P428468 | ENST00000369577 | AAACTACCGTCAGTCTGAAAAAACTTGAAGTACATTCAAATGATCCAGATATGTCTGTT | SEQ ID NO: 1173 | Zinc finger protein 292. [Source:Uniprot/SWISSPROT;Acc:O60281] [ENST00000369577] |
| 306 | A_23_P429491 | FLJ25416 | GGTTGGTCACCTGACATTGTTTTTCATAAAAAGTGACGTGAAGCCAATTCCTGAACTTTTAA | SEQ ID NO: 1174 | Homo sapiens hypothetical protein FLJ25416 (FLJ25416), mRNA [NM_145018] |
| 307 | A_23_P42975 | PRKAR2B | GCCACATTTTTAGAAGACACTGTTTAACATTTTTGCAAAAACCTTCTTGTAGGAAAAGAGAGC | SEQ ID NO: 1175 | Homo sapiens protein kinase, cAMP-dependent, regulatory, type II, beta (PRKAR2B), mRNA [NM_002736] |
| 308 | A_23_P430161 | EXOC8 | AACTACAGGATTTCTTCAGCTAAAATCTGTGTGTTCCAATTACAGTTGTAGCTGAAGGA | SEQ ID NO: 1176 | Homo sapiens exocyst complex component 8 (EXOC8), mRNA [NM_175876] |
| 309 | A_23_P434809 | S100A8 | AAAGGCATGAAGAAAGGCCACAAAGAGATAGGTGAGTTACTGGTGGGCCCAGAGGCTAGGCGCCT | SEQ ID NO: 1177 | Homo sapiens S100 calcium binding protein A8 (S100A8), mRNA [NM_002964] |
| 310 | A_23_P43946 | CIP29 | AAAGAGCAGAGCGGTTGGGATTGGCTGATGAAAAGTTCCTGATACTTTCTGTCTCCAG | SEQ ID NO: 1178 | Homo sapiens cytokine induced protein 29 kDa (CIP29), mRNA [NM_033082] |
| 311 | A_23_P44257 | COMMD8 | AACATTTTACTTCTGCGGCTTCTATGTTGGGAAGACATGCTCTGATAAAAATAGGTGTC | SEQ ID NO: 1179 | Homo sapiens COMM domain containing 8 (COMMD8), mRNA [NM_017845] |
| 312 | A_23_P4462 | A_23_P4462 | GGTCTGAAAAGACAGGAATAACCTATTTTCGTCTGACCGGCTATTAAGGTCTTCTATA | SEQ ID NO: 1180 | |
| 313 | A_23_P44768 | TBK1 | TGTAGTCTGAGTGGGGCTAAAATAAGTTATTTCTCTGACCGGCTACTGAAATATTTTA | SEQ ID NO: 1181 | Homo sapiens TANK-binding kinase 1 (TBK1), mRNA [NM_013254] |
| 314 | A_23_P44974 | MRPL13 | ATGGAGTAAAACAACTGCTACAGTTCAGCACCTGTTTTATGTGCCGAATCACTGTGGGGA | SEQ ID NO: 1182 | Homo sapiens mitochondrial ribosomal protein L13 (MRPL13), nuclear gene encoding mitochondrial protein, mRNA [NM_014078] |
| 315 | A_23_P46396 | PTBP2 | AACCAGGTGGGACCAAAGTTTATGTGCCTTAGTGTTAATTTACCTTGCATTGTAATATT | SEQ ID NO: 1183 | Homo sapiens polypyrimidine tract binding protein 2 (PTBP2), mRNA [NM_021190] |
| 316 | A_23_P48166 | TWF1 | TGGAGCAGACCAATAGGTGAAGGTGTTATTTTCAGTCAGGAGAGTACCTGTCATGAAGGT | SEQ ID NO: 1184 | Homo sapiens twinfilin, actin-binding protein, homolog 1 (Drosophila) (TWF1), mRNA [NM_002822] |
| 317 | A_23_P48897 | CCPG1 | AAGTCAGAGAGCTCATATATAATCTAATGTCCGACGTATGTCCATTCCATGTACCA | SEQ ID NO: 1185 | Homo sapiens cell cycle progression restoration 8 protein (CPR8) mRNA, complete cds. [AF011794] |
| 318 | A_23_P501080 | ZNF92 | GAATATTAAGTGCTACTTGAGGTACGACATTGAGACTACGATTACATTCTTTTGCAGTATAGTGAG | SEQ ID NO: 1186 | Homo sapiens zinc finger protein 92 (ZNF92), transcript variant 1, mRNA [NM_007139] |
| 319 | A_23_P50195 | A_23_P50195 | CCTGCACAAGTGTGATGATTGCTGGGCAAGGTTACTTCATGTTCACACCGTCTTAGACATC | SEQ ID NO: 1187 | |
| 320 | A_23_P502425 | MRPL47 | GTTTCCACAGTCTTGCTGAAGCCCAAAAGTCAAGTCTTCTTGTCTAAGATGTCTGAACTATTAA | SEQ ID NO: 1188 | Homo sapiens mitochondrial ribosomal protein L47 (MRPL47), nuclear gene encoding mitochondrial protein, transcript variant 1, mRNA [NM_020409] |
| 321 | A_23_P502797 | WDFY1 | GTAACAGTTTAGTGGTTGTTCCATTCCTGAATATGCAGGCTAATTTGTACAGATAGGGAT | SEQ ID NO: 1189 | Homo sapiens WD repeat and FYVE domain containing 1 (WDFY1), mRNA [NM_020830] |
| 322 | A_23_P52832 | RBM12 | CTGGGAGTTCTATAGTAGTCAGAGACTTTAGAAAACGAAACAGAAGATGGCTTGTTGCC | SEQ ID NO: 1190 | Homo sapiens RNA binding motif protein 12 (RBM12), transcript variant 1, mRNA [NM_006047] |
| 323 | A_23_P50907 | ITGAV | AAAGAGGTGATTAAGTGAGGTTATTTACCCCTAAATGGTCCATTCTGCATTGTATTTGAGG | SEQ ID NO: 1191 | Homo sapiens integrin, alpha V (vitronectin receptor, alpha polypeptide, antigen CD51) (ITGAV), mRNA [NM_002210] |

Fig. 3-18

| No. | Probe ID No. | Symbols of genes | Sequence | SEQ ID NO: | Description of genes (letters and numbers within [ ] indicates GenBank accession No.) |
|---|---|---|---|---|---|
| 324 | A_23_P51009 | NDUFB3 | CCGGAATGAAGCTTGGAGATACAATGGGTGGGCTTGCAAAGAGTGTTTCCTTTTGTGATGT | SEQ ID NO: 1192 | Homo sapiens NADH dehydrogenase (ubiquinone) 1 beta subcomplex, 3, 12kDa (NDUFB3), mRNA [NM_002491] |
| 325 | A_23_P51317 | CCDC76 | GCCTTGTTATAAGTTTTATGTCAAGTAAGGTAGTTGTTTAAGTTAGTTACCCATGTCCC | SEQ ID NO: 1193 | Homo sapiens coiled-coil domain containing 76 (CCDC76), mRNA [NM_019083] |
| 326 | A_23_P51487 | GBP3 | AATCCTAAAGCATAAGTTAGTCTTTCCTGATTCTAAAGGTCATACTTGAAATCCTGCC | SEQ ID NO: 1194 | Homo sapiens guanylate binding protein 3 (GBP3), mRNA [NM_018284] |
| 327 | A_23_P53658 | NFYB | TGGGCTCATATTGTGCATACCATTTGTAACGTGGTTTTTCACTTAACAATATATTCGG | SEQ ID NO: 1195 | Homo sapiens nuclear transcription factor Y, beta (NFYB), mRNA [NM_006166] |
| 328 | A_23_P53957 | C14orf112 | TTATACTTCCCAGCTATTCCATCTGTGGATGAAAGTAAGAATGTTGGGCAGTATATTT | SEQ ID NO: 1196 | Homo sapiens chromosome 14 open reading frame 112 (C14orf112), mRNA [NM_016468] |
| 329 | A_23_P5611 | RIF1 | ATGTATTCTTGGCTGCTATGCGTGGTTTTTCAGGAAATTTAATATCTTACTGAGATGTG | SEQ ID NO: 1197 | Homo sapiens RAP1 interacting factor homolog (yeast) (RIF1), mRNA [NM_018471] |
| 330 | A_23_P56330 | ZC3H15 | GTCACCCAAGTAAGAAGTGTATCGTCCTTTGCGTTCCATGTTTGTTTTCATTTGGGCATGTG | SEQ ID NO: 1198 | Homo sapiens zinc finger CCCH-type containing 15 (ZC3H15), mRNA [NM_018471] |
| 331 | A_23_P56734 | HNMT | GCTTTGTCCACCATGGATATATCTGAGTGGTTTATTGATGGTAATGAAATGGAGACCT | SEQ ID NO: 1199 | Homo sapiens histamine N-methyltransferase (HNMT), transcript variant 1, mRNA [NM_006895] |
| 332 | A_23_P56739 | KRCC1 | GATATCCGTGTTCATACACTTTCTTATGTGAATAGGTTCTTTAACTTCTAACAAAGGC | SEQ ID NO: 1200 | Homo sapiens lysine-rich coiled-coil 1 (KRCC1), mRNA [NM_016618] |
| 333 | A_23_P58877 | GOPC | AAGGTTCATGTGATTCATGTGTAAGATGCAGATATTGAACATCCTGATTATGTAATCC | SEQ ID NO: 1201 | Homo sapiens golgi associated PDZ and coiled-coil motif containing (GOPC), transcript variant 1, mRNA [NM_020399] |
| 334 | A_23_P58898 | CASP8AP2 | ATGTATATTGTTATTACTCAGTGACTCTCTAATTCAGCATGCAGATGTGTG | SEQ ID NO: 1202 | Homo sapiens CASP8 associated protein 2 (CASP8AP2), mRNA [NM_012115] |
| 335 | A_23_P58912 | SLC35A1 | ATGATCAGTGCGGTTATGTGGAAAGACAACAAAGAACAAAACGAAGCTATCGAGTGAACTGC | SEQ ID NO: 1203 | Homo sapiens solute carrier family 35 (CMP-sialic acid transporter), member A1 (SLC35A1), mRNA [NM_006416] |
| 336 | A_23_P59637 | DOCK4 | TTTGGCAGTGAGCGCTGGAGGTTGAATTTATCTTGAATTTATCATGTGTGTGTATTTCTGAAGCAG | SEQ ID NO: 1204 | Homo sapiens dedicator of cytokinesis 4 (DOCK4), mRNA [NM_014705] |
| 337 | A_23_P59921 | SUB1 | CAGATTGGGAAAATGAGGTAGGTTGTTCGGGATTTTAAAGGCAAAGTGCTAATTGAT | SEQ ID NO: 1205 | Homo sapiens SUB1 homolog (S. cerevisiae) (SUB1), mRNA [NM_006713] |
| 338 | A_23_P60565 | ZNF354A | AAACCAAAGCTCATCGAAGAATACATCCTTGAGAGAGATGTAATAAATGTAATGGATGTG | SEQ ID NO: 1206 | Homo sapiens zinc finger protein 354A (ZNF354A), mRNA [NM_005649] |
| 339 | A_23_P61674 | CLK4 | GAAAGGCATGCAGTTTGTCCATTGTGACAGATTTGTTTAATAAAACCACATACACACTTTA | SEQ ID NO: 1207 | Homo sapiens CDC-like kinase 4 (CLK4), mRNA [NM_020666] |
| 340 | A_23_P62890 | GBP1 | CAAAGATGCATTTACCTGTGTATCAAGTCAGGAAATCTCATAAGCTGGTACCACTCAGGA | SEQ ID NO: 1208 | Homo sapiens guanylate binding protein 1, interferon-inducible, 67kDa (GBP1), mRNA [NM_002053] |
| 341 | A_23_P63190 | NRAS | ATGAATGTCTGAGATACGTCTGTGACTTATCTACGGATTCTGAAGGAAAGGTATATGTATTTG | SEQ ID NO: 1209 | Homo sapiens neuroblastoma RAS viral (v-ras) oncogene homolog (NRAS), mRNA [NM_002524] |
| 342 | A_23_P63205 | DR1 | TCCCAACTAGATGGCCTAGAGTCCAAACATTACCTTTTGAGATGACATTATTGTCTCCATA | SEQ ID NO: 1210 | Homo sapiens down-regulator of transcription 1, TBP-binding (negative cofactor 2) (DR1), mRNA [NM_001939] |

Fig. 3-19

| No. | Probe ID No. | Symbols of genes | Sequence | SEQ ID NO: | Descriptions of genes (letters and numbers within [ ] indicate GenBank accession No.) |
|---|---|---|---|---|---|
| 343 | A_23_P63343 | UTS2 | AGAATCTGGAAACCATACAAGAAACGTGAGACTCCTGATTGCTTCTGGAAATACTGTGTG | SEQ ID NO: 1211 | Homo sapiens urotensin 2 (UTS2), transcript variant 1, mRNA [NM_021995] |
| 344 | A_23_P63655 | ATP5C1 | AGAGAGCTGAAACCAGCCTGGAATATATGGATTGGGATCTTTAGGTCTGTATGAAAAAGCT | SEQ ID NO: 1212 | Homo sapiens ATP synthase, H+ transporting, mitochondrial F1 complex, gamma polypeptide 1 (ATP5C1), nuclear gene encoding mitochondrial protein, transcript variant 2, mRNA [NM_005174] |
| 345 | A_23_P63769 | ZWINT | TCAAAGATTCAGAGAATTGGGCTTTTGTCATCCACTATTGTATGTTTGTTTCATTGACCTC | SEQ ID NO: 1213 | Homo sapiens ZW10 interactor (ZWINT), transcript variant 4, mRNA [NM_001005414] |
| 346 | A_23_P63896 | FAS | ATGTGTATCCACAGCGTAAGCCAGTCTATGAATAGAATAGAAGAAGGTAGACCTTTTCC | SEQ ID NO: 1214 | Homo sapiens Fas (TNF receptor superfamily, member 6) (FAS), transcript variant 1, mRNA [NM_000043] |
| 347 | A_23_P65262 | RP11-208P3.3 | AGCGAAGACTTAACAAGCAGTGACTACGGTTCCCTTGAGCTAGGATATCACAAGGGTTT | SEQ ID NO: 1215 | Human BRCA2 region, mRNA sequence CG016. [U50529] |
| 348 | A_23_P65768 | C15orf15 | TCCTGCATTGGCATCTACATATAATACAGATATTAGGGATGGTTAGATTGCATCTCAGTGTT | SEQ ID NO: 1216 | Homo sapiens chromosome 15 open reading frame 15 (C15orf15), mRNA [NM_016304] |
| 349 | A_23_P66260 | ZNF267 | TGTGATGAATGTGGTAAAGCGTTCAGCTATAGGTCAGATAGCTACTACAGATCGGAGAAGT | SEQ ID NO: 1217 | Homo sapiens zinc finger protein 267 (ZNF267), transcript variant 498723, mRNA [NM_003414] |
| 350 | A_23_P67992 | C1D | AATGAATAATGACGTTATGAAGTATGCTATCGTAGGCTAGAATTATAGGTACATCGTTT | SEQ ID NO: 1218 | Homo sapiens nuclear DNA-binding protein (C1D), transcript variant 1, mRNA [NM_006333] |
| 351 | A_23_P68472 | DPM1 | CTATTGGCGAGGTTCCAATATCATTGTTGGATCGTGTTTATGGTGAATCCAAGTTGGGAG | SEQ ID NO: 1219 | Homo sapiens dolichyl-phosphate mannosyltransferase polypeptide 1, catalytic subunit (DPM1), mRNA [NM_003859] |
| 352 | A_23_P69791 | C4orf16 | GGCTCCATTGATATTTATTAAGGCTTGCTTCACCTTGTAGTAGAAGAGTGCTTAATGGGAT | SEQ ID NO: 1220 | Homo sapiens chromosome 4 open reading frame 16 (C4orf16), mRNA [NM_018569] |
| 353 | A_23_P69908 | GLRX | CTGATAAAACTTACAGCCCCGCTACAGCAAGAGTATCGTGTGAAAGAGCTCCTACACTTT | SEQ ID NO: 1221 | Homo sapiens glutaredoxin (thioltransferase) (GLRX), mRNA [NM_002064] |
| 354 | A_23_P70047 | MATR3 | GCAACAGACAGAAGTAGTTCTGTAGAGATTGACTTCCTAAGGCTACTTAAGACAACTTGCAC | SEQ ID NO: 1222 | Homo sapiens matrin 3 (MATR3), transcript variant 1, mRNA [NM_199189] |
| 355 | A_23_P70318 | ENPP4 | TGTTTTGGGTGTCGTCCTTCGTTGGTGCCCATATCTGATAAGCTTATGGATTATTGCATTT | SEQ ID NO: 1223 | Homo sapiens ectonucleotide pyrophosphatase/phosphodiesterase 4 (putative function) (ENPP4), mRNA [NM_014936] |
| 356 | A_23_P70328 | CENPQ | CAATGCTTACAGTTTCTCTGTCTGTCTGGTCATGTGGAACTTGAAAAATCCTCAAATGCGTTGAG | SEQ ID NO: 1224 | Homo sapiens centromere protein Q (CENPQ), mRNA [NM_018132] |
| 357 | A_23_P7086 | RPL9 | GGTCTCTTGTTGAAATCCGAAATTTGTTGGGGTGAAAATATATCCGCAGGGTTCGCATGA | SEQ ID NO: 1225 | Homo sapiens ribosomal protein L9 (RPL9), transcript variant 1, mRNA [NM_000661] |
| 358 | A_23_P70838 | STARD3NL | GCATTATGTGTATAGGCGTGAAGTGTTGGACTTGGAAAAGGGGAAGAAAGGAATTGCGAAT | SEQ ID NO: 1226 | Homo sapiens STARD3 N-terminal like (STARD3NL), mRNA [NM_032016] |
| 359 | A_23_P71433 | UBE2W | CATGAGCCCTACTGCCTAAACACTATTTCATTTATTTATGTTTGGAAACCCGTAAACAT | SEQ ID NO: 1227 | Homo sapiens ubiquitin-conjugating enzyme E2W (putative) (UBE2W), transcript variant 1, mRNA [NM_001001481] |
| 360 | A_23_P71727 | CKS2 | GATAAAAGTTCCAGTCAGTTTTCTCTTAAGTGCCTGTTTGAGTTTACTGAAACAGT | SEQ ID NO: 1228 | Homo sapiens CDC28 protein kinase regulatory subunit 2 (CKS2), mRNA [NM_001827] |

Fig. 3-20

| No. | Probe ID No. | Symbols of genes | Sequence | SEQ ID NO: | Descriptions of genes (letters and numbers within [ ] indicates GenBank accession No.) |
|---|---|---|---|---|---|
| 361 | A_23_P72503 | KLHL2 | TTTTTGATATTTAACAATGCTTAAGACTTTAAATGCCACTTCTGAGGAAATGGAACCTGGTG | SEQ ID NO: 1229 | Homo sapiens kelch-like 2, Mayven (Drosophila) (KLHL2), mRNA [NM_007246] |
| 362 | A_23_P72568 | SNX4 | AACCTGAGTAATGAGGCTAAATTTACTCTGGTTGGCTCTCTACACGATGGCATTTCAGGGT | SEQ ID NO: 1230 | Homo sapiens sorting nexin 4 (SNX4), mRNA [NM_003794] |
| 363 | A_23_P7282 | ELMOD2 | TTCAAGTAGCTTTCTCTGGGGGAAAAAGTACCACTTGGACACTTAAGGAATGGGATTT | SEQ ID NO: 1231 | ELMO domain-containing protein 2. [Source:Uniprot/SWISSPROT;Acc:Q8IZ81] [ENST00000323570] |
| 364 | A_23_P3114 | PROS1 | CCAGAACAAATTTTAACAAAAGGAACAACCAGAGGGATATAGTGAATATCGTATCATTG | SEQ ID NO: 1232 | Homo sapiens protein S (alpha) (PROS1), mRNA [NM_000313] |
| 365 | A_23_P3577 | DYNLT3 | TGTTTCTTTATGGTGCTGGGCTTTTGTGCCCTGGAAGATCATAATAGTGACCAAAATATAC | SEQ ID NO: 1233 | Dynein light chain Tctex-type 3 (T-complex-associated testis-expressed 1-like) (Protein 91/23). [Source:Uniprot/SWISSPROT;Acc:P51808] [ENST00000378878] |
| 366 | A_23_P73835 | MOSPD1 | TATGTGGAGATGATTTTTCACGTTTAAACTGTAAGCCAAGTGTAAGAAACTCTTGATAGC | SEQ ID NO: 1234 | Homo sapiens motile sperm domain containing 1 (MOSPD1), mRNA [NM_019556] |
| 367 | A_23_P74001 | S100A12 | TGAAGGCTTTTTACCCAGGAACATGTCCTCAATGAGGGTCTTTTCTTTCCCTCAGCAAAACC | SEQ ID NO: 1235 | Homo sapiens S100 calcium binding protein A12 (S100A12), mRNA [NM_005621] |
| 368 | A_23_P74799 | SLC25A24 | GATTCTGTATCTTTTGGAAAAAAGCCGAGAGTTGAAGATAGTATATTTCTGGTAGTAGTG | SEQ ID NO: 1236 | Homo sapiens solute carrier family 25 (mitochondrial carrier; phosphate carrier), member 24 (SLC25A24), transcript variant 2, mRNA [NM_213651] |
| 369 | A_23_P7543 | ZFYVE16 | TCTGCCTCAGCATTATCTAAATGATCTTGATAGTGCTCTGATACCTGTGATCCATGGTGG | SEQ ID NO: 1237 | Homo sapiens zinc finger, FYVE domain containing 16 (ZFYVE16), mRNA [NM_014733] |
| 370 | A_23_P76159 | EEA1 | TATTGTGTTTACTACTTGTGATCATGTAGTTGTGTCCTTACTTTGTGAGAAAGTTAGGTC | SEQ ID NO: 1238 | Homo sapiens early endosome antigen 1 (EEA1), mRNA [NM_003566] |
| 371 | A_23_P76480 | BF213738 | AAATCGAACAGGACGAATGGGTAGATGGGAGCTACATTTACGAAATCGTTTGGGATGACAGG | SEQ ID NO: 1239 | BF213738 601847628F1 NIH_MGC_55 Homo sapiens cDNA clone IMAGE:4078519 5', mRNA sequence [BF213738] |
| 372 | A_23_P76658 | EFHA1 | AAAGTACTTGAGACCAAGGCCAGCATCAATTCCAGACACATCTTCATGTTCCTAATAGGCTA | SEQ ID NO: 1240 | Homo sapiens EF-hand domain family, member A1 (EFHA1), mRNA [NM_152726] |
| 373 | A_23_P76799 | BAZ1A | TACACATGAATGAATCCAATCTTATAACCTTGAAGTGGTGTACCAGTGCTGGCTGCAGGT | SEQ ID NO: 1241 | Homo sapiens bromodomain adjacent to zinc finger domain, 1A (BAZ1A), transcript variant 1, mRNA [NM_013448] |
| 374 | A_23_P76951 | TXNDC1 | ATTTCTGTAATGTCCCCTTCGTTCAGGGCTCTGTTGCTGTGTGAATCCATTAGATTTACA | SEQ ID NO: 1242 | Homo sapiens thioredoxin domain containing 1 (TXNDC1), mRNA [NM_030755] |
| 375 | A_23_P78018 | ABCA5 | ACTGGAGAAGCAAGAACGCACTTGAAATTTTTCTAAGGTCCTTAATTGAAAATGCTGTGGT | SEQ ID NO: 1243 | Homo sapiens ATP-binding cassette, sub-family A (ABC1), member 5 (ABCA5), transcript variant 1, mRNA [NM_018672] |
| 376 | A_23_P78092 | EVI2A | GCTGAATGAGAGACACTTGGAAAAGAACAAAACAGCTCAGAGGACCGAACCTAGTGATGCAA | SEQ ID NO: 1244 | Homo sapiens ecotropic viral integration site 2A (EVI2A), transcript variant 1, mRNA [NM_001003927] |

Fig. 3-21

| No. | Probe ID No. | Symbols of genes | Sequence | SEQ ID NO: | Descriptions of genes (letters and numbers within [ ] indicates GenBank accession No.) |
|---|---|---|---|---|---|
| 377 | A_23_P79199 | DBI | TGCTCACGATACGGCTCTAACAGATTAGGGGCTAAAACGATTACTGACTTCCTTGAGTA | SEQ ID NO: 1245 | Homo sapiens diazepam binding inhibitor (GABA receptor modulator, acyl-Coenzyme A binding protein) (DBI), transcript variant 1, mRNA [NM_020548] |
| 378 | A_23_P81212 | MRPS18C | ATGGGGTTTATGGCAGTTACATACGAAGGATCCTGCATATGTCAAGGACCGTAAAGTTGT | SEQ ID NO: 1246 | Homo sapiens mitochondrial ribosomal protein S18C (MRPS18C), nuclear gene encoding mitochondrial protein, mRNA [NM_016067] |
| 379 | A_23_P81248 | TAF7 | TGCTAGTTTGGATATGTTTCCTATGCAATAGTAGTTGTTTTCCAGTTATTGAAAACAGGTT | SEQ ID NO: 1247 | Homo sapiens TAF7 RNA polymerase II, TATA box binding protein (TBP)-associated factor, 55kDa (TAF7), mRNA [NM_005642] |
| 380 | A_23_P82047 | BU507302 | TCTGTTTCGTTAATGTCAGGTGCCTGAACATTCAGGAGTTTATAAATTGCTTAATTTGTG | SEQ ID NO: 1248 | AGENCOURT_10309688 NIH_MGC_71 Homo sapiens cDNA clone IMAGE:6501220 5', mRNA sequence [BU507302] |
| 381 | A_23_P8241 | FBXO5 | GATACGAACAGAAAATATCAACTTCTGGAGTCTATTAAATGTGTTGTCACCTTTCTAAAGC | SEQ ID NO: 1249 | Homo sapiens F-box protein 5 (FBXO5), mRNA [NM_012177] |
| 382 | A_23_P83175 | PTPLAD2 | CATCCTTTTTGTGGTGATGATCACGAGTCAAGAGGAAGTCAAGAGAAATATGTGGTGTGT | SEQ ID NO: 1250 | Homo sapiens protein tyrosine phosphatase-like A domain containing 2 (PTPLAD2), mRNA [NM_0010109151] |
| 383 | A_23_P83278 | CHMP5 | CATTGGTCTTTATTTTTTCCATTAAGAACTCATTGCTTGGGAAATGCTTCTTGGTAG | SEQ ID NO: 1251 | Homo sapiens chromatin modifying protein 5 (CHMP5), mRNA [NM_016410] |
| 384 | A_23_P84070 | LARP7 | TGATTTGCTAGAAGGGGATACAGAATGCCATGCTAGAATTAAGACTCCTGAGGATGCTCA | SEQ ID NO: 1252 | Homo sapiens La ribonucleoprotein domain family, member 7 (LARP7), transcript variant 1, mRNA [NM_016648] |
| 385 | A_23_P86653 | SRGN | AGGACTTGGGTCAACATGGATTAGAAGAGGATTTTATGTTATAAAAGAGGATTTCGCAC | SEQ ID NO: 1253 | Homo sapiens serglycin (SRGN), mRNA [NM_002727] |
| 386 | A_23_P87769 | C12orf48 | GTAAGAAATATGGTCAGTTCGGTCCTAATGCATATTGTGACTGTTTGCATATACTCTGTT | SEQ ID NO: 1254 | Homo sapiens chromosome 12 open reading frame 48 (C12orf48), mRNA [NM_017915] |
| 387 | A_23_P87879 | CD69 | TGTGCAATATATGTGATGTGGCAAATCTGTATTAGGAAATATTCTGTAATGTTCAGACCTAG | SEQ ID NO: 1255 | Homo sapiens CD69 molecule (CD69), mRNA [NM_001781] |
| 388 | A_23_P89145 | ZNF83 | GTATAATGAATGTAGCAAGAGCCTTTAGTTTTTTGTTCAAGGCTTAATAACGGTTAGCTAGA | SEQ ID NO: 1256 | Homo sapiens zinc finger protein 83 (ZNF83), mRNA [NM_018300] |
| 389 | A_23_P89755 | RNF138 | TGTGACCGTGATATAGTGCAGAAAGATCCTACCAACCACTGTTTCACTACTTTTTAGTTAA | SEQ ID NO: 1257 | Homo sapiens ring finger protein 138 (RNF138), transcript variant 1, mRNA [NM_016271] |
| 390 | A_23_P89921 | ZNF180 | AGTTGCATCATTTACTACATGATCTTCCAATTAGATAGCTGTAATCTGTTTACAAGC | SEQ ID NO: 1258 | Homo sapiens zinc finger protein 180 (ZNF180), mRNA [NM_013256] |
| 391 | A_23_P9056 | RB1CC1 | TTCATTTTCAAAGGGCATACCTTGTGCATTGTGGCTTATGATGAGCCATATTAATTGC | SEQ ID NO: 1259 | Homo sapiens RB1-inducible coiled-coil 1 (RB1CC1), mRNA [NM_014781] |
| 392 | A_23_P91346 | BC006667 | GGGCTTAGGAGTGAGAGTTCTGCTGTACAAGAAATGATGATGCTCATGAATTTTGACATT | SEQ ID NO: 1260 | Homo sapiens cDNA clone MGC:17708 IMAGE:3868595, complete cds. [BC006667] |
| 393 | A_23_P92410 | CASP3 | TGCACGAAGTCTCACTGGCTGTCAGTATGATGACATTTCACGGGAGATTCTTGTTGCTCAAA | SEQ ID NO: 1261 | Homo sapiens caspase 3, apoptosis-related cysteine peptidase (CASP3), transcript variant alpha, mRNA [NM_004346] |
| 394 | A_23_P92441 | MAD2L1 | TGTACCTGAAAAATGGGAAGAGTCGGACCACAGTTTATTACCAATTCTGAGGAAGTCCG | SEQ ID NO: 1262 | Homo sapiens MAD2 mitotic arrest deficient-like 1 (yeast) (MAD2L1), mRNA [NM_002358] |

Fig. 3-22

| No. | Probe ID No. | Symbols of genes | Sequence | SEQ ID NO: | Descriptions of genes (letters and numbers within [ ] indicates GenBank accession No.) |
|---|---|---|---|---|---|
| 395 | A_23_P92842 | SAR1B | TAATCTGAGATCACCCGAGCGCCATTTGTAAAGAGCAACTTTCCAGCAGTACATTTGAAG | SEQ ID NO: 1263 | Homo sapiens SAR1 gene homolog B (S. cerevisiae) (SAR1B), transcript variant 2, mRNA [NM_016103] |
| 396 | A_23_P933 | RWDD3 | GGAATCTTTTAGTAGTAAAATAGCAGTGTTTTTTGTTGTTTTGGATTGGATTTGGGGAGTGG | SEQ ID NO: 1264 | Homo sapiens RWD domain containing 3 (RWDD3), mRNA [NM_015485] |
| 397 | A_23_P94230 | LY96 | TGAAGGTATTTCTGGGAGCCCAGAAGACAAGAAATGCTCTTTTGCTTGGAGTTTGTGATCCTACGA | SEQ ID NO: 1265 | Homo sapiens lymphocyte antigen 96 (LY96), mRNA [NM_015364] |
| 398 | A_23_P94601 | ANXA1 | GGCTCTTTGTCGAGGAAAACTAAACATTCCCATTGATCTCTCAAGCTATGATCAGAAGACT | SEQ ID NO: 1266 | Homo sapiens annexin A1 (ANXA1), mRNA [NM_000700] |
| 399 | A_23_P94546 | GKAP1 | TACCAGGGTGGCAGAAAAGGGAAAAGAAACTCTGAATCCGACCAGTGTAGGTGATTACAT | SEQ ID NO: 1267 | Homo sapiens G kinase anchoring protein 1 (GKAP1), mRNA [NM_025211] |
| 400 | A_23_P95130 | SLC37A3 | TTGAGGGATACCTAATTTGCATTCGGTTAGGGGGATATTTTCAACCTCTTGCTTTATACT | SEQ ID NO: 1268 | Homo sapiens solute carrier family 37 (glycerol-3-phosphate transporter), member 3 (SLC37A3), transcript variant 1, mRNA [NM_207113] |
| 401 | A_23_P95594 | NAT1 | TGCTTGGAGAGAAAGGTTGTGCCGAAACATGGTGATAGATTTTTTACTATTTAGAATAAG | SEQ ID NO: 1269 | Homo sapiens N-acetyltransferase 1 (arylamine N-acetyltransferase) (NAT1), mRNA [NM_000662] |
| 402 | A_23_P9574 | ECT2 | TAATAGTTAACTGACTATAGATTGTTTTCTATGCATGTATGTGCCACTTCTGAGAGTAG | SEQ ID NO: 1270 | Homo sapiens epithelial cell transforming sequence 2 oncogene (ECT2), mRNA [NM_018098] |
| 403 | A_23_P98382 | TIMM8B | TGTTAGTAAGCAGATTTAAGGTCAGTGGGGGAAGGCTATCAACCCATTGTCAGATCAG | SEQ ID NO: 1271 | Homo sapiens translocase of inner mitochondrial membrane 8 homolog B (yeast) (TIMM8B), mRNA [NM_012459] |
| 404 | A_23_P98446 | SC5DL | TGTGAACACCAGGACTTTAATCTTATGCTTAAAATGCCAGATGTTGTTCGGGGGACAACT | SEQ ID NO: 1272 | Homo sapiens sterol-C5-desaturase (ERG3 delta-5-desaturase homolog, S. cerevisiae)-like (SC5DL), transcript variant 2, mRNA [NM_001024956] |
| 405 | A_23_P99405 | ZMYM2 | GCTGGGTATTACCATGTAAAAAACGCTAGAGTTAGTCTCTTTTGAAGTTGCCATTATTCTATGTAGTGGT | SEQ ID NO: 1273 | Homo sapiens zinc finger, MYM-type 2 (ZMYM2), mRNA [NM_003453] |
| 406 | A_23_P99693 | ZBTB1 | TATTAGAGTCTAAAAAAACCCACTTCATTGGACATGTTGGAATAGCAAAGGAGGTATAGAGA | SEQ ID NO: 1274 | Homo sapiens zinc finger and BTB domain containing 1 (ZBTB1), mRNA [NM_014950] |
| 407 | A_23_P99853 | KIAA1370 | CTTTTGTACTGTTGAAACCACTTCAATTGGACATGTTGGAATAGCAAAAGGGCAGTTAG | SEQ ID NO: 1275 | Homo sapiens KIAA1370 (KIAA1370), mRNA [NM_019600] |
| 408 | A_23_P99980 | HMGB1 | GGATTCTTTCCATTTGCATTTGTTTTATGTAATTTCAGGAGGAAATACTGAACATCTGAGTC | SEQ ID NO: 1276 | Homo sapiens high-mobility group box 1 (HMGB1), mRNA [NM_002128] |
| 409 | A_23_P99985 | HMGB1 | TGGGCCAGGTTTTCAAACAAAGATGCCACATTCAAAATAGGGTATATTTTCCTATATTAC | SEQ ID NO: 1277 | Homo sapiens high-mobility group box 1 (HMGB1), mRNA [NM_002128] |
| 410 | A_23_P100387 | GK | TAAAAGGTTCTGTTTTTGTTTTGGAATCAATAACAGTGCAGTAATTCACCTATGTCTGATGTCTG | SEQ ID NO: 1278 | Homo sapiens glycerol kinase (GK), transcript variant 1, mRNA [NM_203391] |
| 411 | A_24_P105648 | BX111927 | TTATGAGATGGTTCAGTTCAAATAACAGTGCAGTAATTCACCTATATCTAAAAGACTGGC | SEQ ID NO: 1279 | BX111927 Soares_multiple_sclerosis_2NbHMSP Homo sapiens cDNA clone IMAGp998G05619, mRNA sequence [BX111927] |
| 412 | A_24_P105913 | THC2606573 | GTGTGGCTCTAGGAAATGCAGCAATACCAAAGGTCAATGTGGAAATATGGGCATGTTTGCC | SEQ ID NO: 1280 | AY151386 NAP1 [Homo sapiens] (exp=-1; wgp=0; cg=0), partial (35%) [THC2606573] |
| 413 | A_24_P108308 | RPL26L1 | TGGCAAGGTAGTGCAGGTGTACAGAAAGAAATATGCATGTACATCGACCGGGTGCAGCG | SEQ ID NO: 1281 | Homo sapiens ribosomal protein L26-like 1 (RPL26L1), mRNA [NM_016093] |

Fig. 3-23

| No. | Probe ID No. | Symbols of genes | Sequence | SEQ ID NO: | Descriptions of genes (letters and numbers within [ ] indicates GenBank accession No.) |
|---|---|---|---|---|---|
| 414 | A_24_P107257 | LIN7C | TATTAGTGTGGGACTGTGACTGAGGTCTTAAAGACTGAAAGAGTTGGGGTTCATTTTCTG | SEQ ID NO: 1282 | Homo sapiens lin-7 homolog C (C. elegans) (LIN7C), mRNA [NM_018362] |
| 415 | A_24_P11045 | THC2785765 | CCGACGAGAAACGTACACCTGATTTTCAATGACAAATACGGTAGGAACAGAAGTCAGAATAG | SEQ ID NO: 1283 | COX7B_HUMAN (P24311) Cytochrome c oxidase polypeptide VIIb, mitochondrial precursor partial (78%) mRNA [THC2785765] |
| 416 | A_24_P114249 | GALNT3 | ATTTCAAATGCAGAATACTTGAGTCATTTAAAGGTAAATTTTGTTACTGATTCAATTATA | SEQ ID NO: 1284 | Homo sapiens UDP-N-acetyl-alpha-D-galactosamine:polypeptide N-acetylgalactosaminyltransferase 3 (GalNAc-T3) (GALNT3), mRNA [NM_004482] |
| 417 | A_24_P115774 | BIRC2 | GATACGATTTTGGTTAAAGGAAAATGCTGGGGCGCAACATCTTCAAAAGTGTCTAAAAGAA | SEQ ID NO: 1285 | Homo sapiens baculoviral IAP repeat-containing 2 (BIRC2), mRNA [NM_001166] |
| 418 | A_24_P116766 | ZNF207 | TTTCTGAGACGACGTATACGAGTGAAATTAGCTTCTGAGTAAATTTCTAATTATGCCC | SEQ ID NO: 1286 | Homo sapiens mRNA; cDNA DKFZp761N202 (from clone DKFZp761N202), [AL834501] |
| 419 | A_24_P123521 | CLK4 | CGGACACTGAAAAACGACAGATATCAAAGTTGTTGACTTTGGAAGTGCAACGTATGATGAT | SEQ ID NO: 1287 | Homo sapiens CDC-like kinase 4 (CLK4), mRNA [NM_020666] |
| 420 | A_24_P124325 | IKZF5 | GCTACAACTTCTTGAACTTCAAGTTAAGGGTAGAGCATTTACTTTGAAAAATCCACTGG | SEQ ID NO: 1288 | Homo sapiens mRNA; cDNA DKFZp781B0249 (from clone DKFZp781B0249), [CR749800] |
| 421 | A_24_P124992 | PSMA4 | AAACGTCCCTTTGGTGTTGTTCATTGCTACATTGCTGGGATAAGCACTATGGCTTTCAG | SEQ ID NO: 1289 | Homo sapiens proteasome (prosome, macropain) subunit, alpha type, 4 (PSMA4), mRNA [NM_002789] |
| 422 | A_24_P126741 | ENST00000309178 | AGGCTCCAACAGCACACGTAAGAAGATTCAAGATTACTTGGCAACAGCTCACAGGAGCGGAGAAT | SEQ ID NO: 1290 | |
| 423 | A_24_P127181 | LOC442237 | AACTGAAATCTTCCAGAAAATCCAAGTCCAGCTAGTAGAATTGGAGAAAAAGTTCAGTG | SEQ ID NO: 1291 | PREDICTED: Homo sapiens similar to 40S ribosomal protein S7 (S8) (LOC442237), mRNA [XR_018963] |
| 424 | A_24_P127621 | A_24_P127621 | TCGAAAGCAAGTACCACACAAAAGGCATTTCAATGCACTTTCCCACATTCTCAGAAATATTAG | SEQ ID NO: 1292 | |
| 425 | A_24_P129232 | SERINC1 | CAGGTCAGAGAATGATGGAATGTTTTAGAATAAAGTCCTGCTTATAGTATACTACACAG | SEQ ID NO: 1293 | Homo sapiens serine incorporator 1 (SERINC1), mRNA [NM_020755] |
| 426 | A_24_P132787 | RAB18 | TAAAACCTCACATTCTACTTGATTTACACTTCCTAGTCTACATTACATGTGGTTGAAGG | SEQ ID NO: 1294 | Homo sapiens RAB18, member RAS oncogene family (RAB18), mRNA [NM_021252] |
| 427 | A_24_P133991 | ANKRD12 | TTTGGAATGGAGTATATGCCTGAAAAGGTTTTGGATTCAGAAAGAAAAAGGATGGTTAGT | SEQ ID NO: 1295 | Homo sapiens ankyrin repeat domain 12 (ANKRD12), mRNA [NM_015208] |
| 428 | A_24_P134352 | STCH | TGAGTAACTTATTTGTATCAGGAATGTTTTGGTACTGTGTTTCACTCAAAACACTGAC | SEQ ID NO: 1296 | Homo sapiens stress 70 protein chaperone, microsome-associated, 60kDa (STCH), mRNA [NM_006948] |
| 429 | A_24_P135242 | A_24_P135242 | GATGGCAAGAAAAGGTGGCAAGCTACTTGTACGTGGGAACCGAAACTGGGCATTTGTCAT | SEQ ID NO: 1297 | |
| 430 | A_24_P135551 | LOC130865 | TAACAGCATAGCTGTCCCTGTGGGCATTCAGCCAAAAGGTGGTTATGACTAGACTAAAAGT | SEQ ID NO: 1298 | PREDICTED: Homo sapiens similar to 60S ribosomal protein L26 (Silica-induced gene 20 protein) (Sig-20) (LOC130865), mRNA [XR_019454] |
| 431 | A_24_P139208 | USP25 | GAATATACAGCAAGGTGATTATTCAAGAGAATCCGAAAGTACTTGAATAAGGGCTATTG | SEQ ID NO: 1299 | Homo sapiens ubiquitin specific peptidase 25 (USP25), mRNA [NM_013396] |
| 432 | A_24_P144383 | A_24_P144383 | GTGCGTTGAGGCCAAAAGTGCTGGCTAAAAGATGCAAGCATTTTGAACT | SEQ ID NO: 1300 | |

Fig. 3-24

| No. | Probe ID No. | Symbols of genes | Sequence | SEQ ID NO: | Descriptions of genes [letters and numbers within [ ] indicate GenBank accession No.] |
|---|---|---|---|---|---|
| 433 | A_24_P144666 | LOC401975 | TGTCGATGTCAAGACTAATGATGGCTAGTTCTTTAATCTGTTCTGTGTTGGTTTTACTGA | SEQ ID NO: 1301 | PREDICTED: Homo sapiens similar to ribosomal protein S3a (LOC401975), mRNA [XR_017247] |
| 434 | A_24_P148151 | TSNAX | AAAGTTGAGTTATATACTTCTACATACAATGGAAATGCTTTTTAGTAATGATTATTTAGCA | SEQ ID NO: 1302 | Homo sapiens translin-associated factor X (TSNAX), mRNA [NM_005999] |
| 435 | A_24_P152753 | LOC285260 | TGTCTCATACCGAATCCGTGTGCGATTATCAGAAAGGATGAAGATTCACCAAATAAGCT | SEQ ID NO: 1303 | PREDICTED: Homo sapiens similar to ribosomal protein L31 (LOC285260), mRNA [XR_019376] |
| 436 | A_24_P153324 | LOC390413 | GAAGCTAACAAGGTTCAATTAACATGCTGGGGATTGTAGAACCATATATTGCAGGGTA | SEQ ID NO: 1304 | PREDICTED: Homo sapiens similar to 60S ribosomal protein L7 (LOC390413), mRNA [XR_018341] |
| 437 | A_24_P153511 | OSBPL8 | CCTTGTGCCATATACAACACAAAATTTGTGGAAGGCAGTTTTAACTTTCTGAAGATATC | SEQ ID NO: 1305 | Homo sapiens oxysterol binding protein-like 8 (OSBPL8), transcript variant 1, mRNA [NM_020841] |
| 438 | A_24_P15765 | AK098605 | TCCAAGTCTGGCTAGTACGTGAATTGGAGAAAAAGTTGGGAAGCATGTTGTCTTTATTG | SEQ ID NO: 1306 | Homo sapiens cDNA FLJ25739 fis, clone TST05834, [AK098605] |
| 439 | A_24_P161914 | LOC130728 | CTATACTGTTGGAAAACACTTCAAAGAAAAATAACTTCCTGCGGCCATTCAAATTACTTC | SEQ ID NO: 1307 | PREDICTED: Homo sapiens similar to 60S ribosomal protein L7 (LOC130728), mRNA [XR_019248] |
| 440 | A_24_P165816 | AK023645 | AAGATTGAATGGCTAGGAGTAATTCTTGTTCTCGTATAGGGAACTTAACTTCACTGTGGAA | SEQ ID NO: 1308 | Homo sapiens cDNA FLJ13583 fis, clone PLACE1009050, [AK023645] |
| 441 | A_24_P167063 | ZNF518 | AAAGAAAGCCATACATAGAATGCTTCAAGCTATGTCTGCTATGCACATTATACTGTAGTG | SEQ ID NO: 1309 | Homo sapiens zinc finger protein 518 (ZNF518), mRNA [NM_014803] |
| 442 | A_24_P169378 | RPS7 | AACTGAAATCTTTGGAGAAAATCCAAATCGGCTAGTAAGTAAGTTGGAGAAAAAGTTCA | SEQ ID NO: 1310 | Homo sapiens ribosomal protein S7 (RPS7), mRNA [NM_001011] |
| 443 | A_24_P170025 | A_24_P170025 | TCCATGCTATTGTTGTGTCAGAGGGAGTACCTGTTATTAAAGTGGCCATTGATAATGCTC | SEQ ID NO: 1311 | |
| 444 | A_24_P171873 | FBXO4 | GATTCCACAGATTCAAAAGTGTGTGAAGTGTAGATGGGTTCATCTATGTTGCAAATGC | SEQ ID NO: 1312 | Homo sapiens F-box protein 4 (FBXO4), transcript variant 1, mRNA [NM_012176] |
| 445 | A_24_P172481 | TRIM22 | TGCCCCTTAAAGATTGAAGAAGAGAAACTTGTCAACTCATATCCACGTTATCTAGGCAA | SEQ ID NO: 1313 | Homo sapiens tripartite motif-containing 22 (TRIM22), mRNA [NM_006074] |
| 446 | A_24_P175059 | ATG5 | TTGCACAAGAGGCTGGTCTGAATATGATTGTTCACATTAAGAGTGTTTATCGTCGGTTC | SEQ ID NO: 1314 | Homo sapiens ATG5 autophagy related 5 homolog (S. cerevisiae) (ATG5), mRNA [NM_004849] |
| 447 | A_24_P175176 | PHTF2 | AGATTGAGGTTAACTTAAGTTGGGAGTTGATTTATTAAGTACAGTATACCTCTCAACAG | SEQ ID NO: 1315 | Homo sapiens putative homeodomain transcription factor 2 (PHTF2), mRNA [NM_020432] |
| 448 | A_24_P175187 | SAMD9 | CAACCAGGGATACGTAATGAAACAGTAATTTTCCCCTAATAAATATGGATATATGGGCAG | SEQ ID NO: 1316 | Homo sapiens sterile alpha motif domain containing 9 (SAMD9), mRNA [NM_017654] |
| 449 | A_24_P175188 | SAMD9 | TGCCAATGTACTGGCAGATTAACATAACGTATGTTTTGAACAAAACAACCAGGGATA | SEQ ID NO: 1317 | Homo sapiens sterile alpha motif domain containing 9 (SAMD9), mRNA [NM_017654] |
| 450 | A_24_P178351 | TPT1 | GAAAGAGACAGAAAAGAGATAAAACGTTTATGACAGGGGCTGCAGAACAAATCAAGCAC | SEQ ID NO: 1318 | Homo sapiens tumor protein, translationally-controlled 1 (TPT1), mRNA [NM_003295] |
| 451 | A_24_P180424 | TMEM30A | CAATGTGTATCGACATCTCTCTTTAGTTAAGGACGCAATTGTTTTGGTTGGTTTTCCTAAG | SEQ ID NO: 1319 | Homo sapiens transmembrane protein 30A (TMEM30A), mRNA [NM_018247] |
| 452 | A_24_P183864 | IMPA1 | TCAGCCTTATCCCTTGGCACGTAACACAGACTACTAGACTTATTGTAGGTTCGTTTGAGCT | SEQ ID NO: 1320 | Homo sapiens inositol(myo)-1(or 4)-monophosphatase 1 (IMPA1), mRNA [NM_005536] |
| 453 | A_24_P183944 | LOC389404 | AGGAACCCTGCGGAGGGAACTTCAATCACATGTAGAACTGACTCAGTGTTCTGGAAAGAAAAA | SEQ ID NO: 1321 | PREDICTED: Homo sapiens similar to 60S ribosomal protein L9 (LOC389404), mRNA [XR_018133] |

Fig. 3-25

| No. | Probe ID No. | Symbols of genes | Sequence | SEQ ID NO: | Descriptions of genes (letters and numbers within [ ] indicates GenBank accession No.) |
|---|---|---|---|---|---|
| 454 | A_24_P191417 | NAB1 | AAGTTTCCTTAACTATCTTATGTTCTTAGTCTTGTTCAAGCTTAGTG ATAAGGTGAAGCAC | SEQ ID NO: 1322 | Homo sapiens NGFI-A binding protein 1 (EGR1 binding protein 1) (NAB1), mRNA [NM_005966] |
| 455 | A_24_P191833 | SFRS12 | AAGGACTTACGAGTATATGGGAAGGTTATGGTTTTATGTTTAAGG ATACGTTTACTTGAG | SEQ ID NO: 1323 | Homo sapiens splicing factor, arginine/serine-rich 12 (SFRS12), transcript variant 2, mRNA [NM_139168] |
| 456 | A_24_P192555 | DNAJA1 | TATAGGAAGGTGTTCTTTAGGTATGTTACAGGATTACTTTAAACC ATTTGACTTTCGCTC | SEQ ID NO: 1324 | DnaJ homolog subfamily A member 1 (Heat shock 40 kDa protein 4) (DnaJ protein homolog 2) (HSJ-2) (HSDJ). [Source:Uniprot/SWISSPROT;Acc:P31689] [ENST00000330899] |
| 457 | A_24_P194313 | C21orf66 | ATTTAAATTAAGCCTCTCAGTTAATTGTCCCGCTGTAAACGATGTG TGCAGTGTAAATTGT | SEQ ID NO: 1325 | Homo sapiens chromosome 21 open reading frame 66 (C21orf66), transcript variant 1, mRNA [NM_016631] |
| 458 | A_24_P199500 | RNF2 | AAACTGCTTAGATTTTGTTGATGACATTAGATTAGTTAGTTCATT AAATAACTAAATTCC | SEQ ID NO: 1326 | Homo sapiens ring finger protein 2 (RNF2), mRNA [NM_007212] |
| 459 | A_24_P201702 | CLEC2B | ATTGGAATTCAAGTAAATACAAGTGTTCCACTCAACATGCCGACC TAACTATATATTGACA | SEQ ID NO: 1327 | Homo sapiens C-type lectin domain family 2, member B (CLEC2B), mRNA [NM_005127] |
| 460 | A_24_P203909 | RPL34 | GAGGGGTTCGTCGTGTAAGACTTAAAGTTCTTATGAAATTGTCCA AAGAAACAAACATG | SEQ ID NO: 1328 | Homo sapiens ribosomal protein L34 (RPL34), transcript variant 2, mRNA [NM_033625] |
| 461 | A_24_P208045 | EDEM3 | TTTAGAGGGGGGTAGAATTTAGTAAATATTCCAGCCAGGTGTTTTT ATGCACAAGGCTCA | SEQ ID NO: 1329 | Homo sapiens ER degradation enhancer, mannosidase alpha-like 3 (EDEM3), mRNA [NM_025191] |
| 462 | A_24_P20996 | BC043173 | AAGGAAAATGTTCATATATGTATATGAATCTCTCTTTATGCTG AAGGGCTCTGATTGG | SEQ ID NO: 1330 | Homo sapiens cDNA clone IMAGE:5287121. [BC043173] |
| 463 | A_24_P212864 | LOC645161 | ACAGAAGTACAACGTTGCGATCCATGATCCGAAAGAATGAATGAAGT TAGGCTGTATGAGG | SEQ ID NO: 1331 | PREDICTED: Homo sapiens similar to 60S ribosomal protein L26 (LOC646161), mRNA [XR_018048] |
| 464 | A_24_P213375 | A_24_P213375 | AAATGTTGTTCCATGATCAAAAATGGGAGACAATGATTCTTCATC TGTTCTGTGTTGGTT | SEQ ID NO: 1332 | |
| 465 | A_24_P213783 | RPL31 | CTTTGGTTACCTATGTACGTGTTTACGACTTTCAAAAATCTACAGA CAGTCAATGATGATG | SEQ ID NO: 1333 | Homo sapiens ribosomal protein L31 (RPL31), mRNA [NM_000993] |
| 466 | A_24_P221375 | A_24_P221375 | TACTTTGGTTACCCATGATCACCACTACCACTTTCAAAAATCTACAGAG AGTCAATGTGGAGGA | SEQ ID NO: 1334 | |
| 467 | A_24_P222911 | SFRS7 | CAGAAAATGTCAATGAGAGTAAAGTGGTTTTGTAAATGTCAGCTAT ATTTAGCAACACTCC | SEQ ID NO: 1335 | Homo sapiens splicing factor, arginine/serine-rich 7, 35kDa (SFRS7), mRNA [NM_001031684] |
| 468 | A_24_P225308 | ARID4B | GTTGAAAATGGTTTCGAAGTTATTCAAAGTTTCAAGGACTGTAAA GATTTGTTCACAGCA | SEQ ID NO: 1336 | Homo sapiens AT rich interactive domain 4B (RBP1-like) (ARID4B), transcript variant 1, mRNA [NM_016374] |
| 469 | A_24_P225468 | ANP32E | TCATCTTAGTGTGCATCGAAAATTAGAGTACTTTGGTTTGAAAAC AACACTTAGAGCCTC | SEQ ID NO: 1337 | Homo sapiens acidic (leucine-rich) nuclear phosphoprotein 32 family, member E (ANP32E), mRNA [NM_030920] |
| 470 | A_24_P225719 | PREI3 | GACTATTTTCTTAGTGAATATTTATACTAAGGTAGTGACTGAGAT TTGGTGATCGTGGTG | SEQ ID NO: 1338 | Homo sapiens preimplantation protein 3 (PREI3), transcript variant 1, mRNA [NM_015387] OTTHUMP00000016694. [Source:Uniprot/SPTREMBL;Acc:Q9NU98] |
| 471 | A_24_P229066 | ENST00000078131 | AAGAAGCTCCAGAACAAGAGACGAGGTTATGTCACCGATCTGATG AACCAGATTCAAGAGA | SEQ ID NO: 1339 | [ENST00000078131] |

Fig. 3-26

| No. | Probe ID No. | Symbols of genes | Sequence | SEQ ID NO: | Descriptions of genes (letters and numbers within [ ] indicate GenBank accession No.) |
|---|---|---|---|---|---|
| 472 | A_24_P232856 | RPL9 | GAACCCTGCGGAGGGACTTCAATCACATCAATGTAGAAACTCAGCCTTCTTGGAAAGAAAA | SEQ ID NO: 1340 | Homo sapiens ribosomal protein L9 (RPL9), transcript variant 1, mRNA [NM_000661] |
| 473 | A_24_P234792 | CSNK1G3 | GGGTTTTTGGATTGTACAGTGTTTATATGATCTGAACTCGTTATACATAAGAAGGTGTG | SEQ ID NO: 1341 | Homo sapiens casein kinase 1, gamma 3 (CSNK1G3), transcript variant 1, mRNA [NM_004384] |
| 474 | A_24_P235429 | ABCA1 | CCAAAGAGCCATGTGTGTCATGTAATACTGAACCACTTGATATTGAGAGATTAATTTGTAC | SEQ ID NO: 1342 | Homo sapiens ATP-binding cassette, sub-family A (ABC1), member 1 (ABCA1), mRNA [NM_005502] |
| 475 | A_24_P236008 | SCYL2 | ATAGAGTATGTACTTGTCTGGTTTTGTTTTGTTTTATTTTGGAATGCTTATAAGCTCC | SEQ ID NO: 1343 | Homo sapiens mRNA for KIAA1360 protein, partial cds. [AB037781] |
| 476 | A_24_P242299 | ZRANB2 | GACTTTTTGAAAGTCTACCTTCTAAATTGCCCCGAGGATCTAGATTGTAGATGTTACCAT | SEQ ID NO: 1344 | Homo sapiens zinc finger, RAN-binding domain containing 2 (ZRANB2), transcript variant 2, mRNA [NM_005455] |
| 477 | A_24_P243749 | PDK4 | ATTTGACATTTGTGTGTGTAATTTCATGGTGGCTGGCCTAGTGTTGTGGTGCTTCTGGTAATGGTA | SEQ ID NO: 1345 | Homo sapiens pyruvate dehydrogenase kinase, isozyme 4 (PDK4), mRNA [NM_002612] |
| 478 | A_24_P250922 | PTGS2 | TGAGATATTTAAGGTTGAATGTTTGTCCTTAGGATAGGCCTATGTGCTAGGCCACAAAGA | SEQ ID NO: 1346 | Homo sapiens prostaglandin-endoperoxide synthase 2 (prostaglandin G/H synthase and cyclooxygenase) (PTGS2), mRNA [NM_000963] |
| 479 | A_24_P25328 | ZMYM6 | AGCACTATTTAAATCAGTGTCTGTAACTCAGTTTTGGATAAAATGCAAAGACAAGTTACCC | SEQ ID NO: 1347 | Homo sapiens zinc finger, MYM-type 6 (ZMYM6), mRNA [NM_007167] |
| 480 | A_24_P255252 | A_24_P255252 | TGGAGTACTGGAAGGATGGTGTGACTCCAATGTGATTGTTCTTTGAGGATGATTTAGAAA | SEQ ID NO: 1348 | |
| 481 | A_24_P257151 | CLK1 | TATGGAAGTCTGTGAATTTTTGCACAGTAATAAGTTGACTCACACAGACTAAAGCCTG | SEQ ID NO: 1349 | Homo sapiens CDC-like kinase 1 (CLK1), transcript variant 1, mRNA [NM_004071] |
| 482 | A_24_P263524 | TXNDC9 | TGACTTCAGCACAGAAAAGTTTAGAATGGGGGCTCAGTTGTTCTGACATTCTTAATTACAG | SEQ ID NO: 1350 | Homo sapiens thioredoxin domain containing 9 (TXNDC9), mRNA [NM_005783] |
| 483 | A_24_P265856 | SENP7 | TTGTGTGTGTTGGGGGGTAGTTTAAAGGTGAGTATTGTTTTGTACATCTAATTTTGGGA | SEQ ID NO: 1351 | Homo sapiens SUMO1/sentrin specific peptidase 7 (SENP7), transcript variant 1, mRNA [NM_020654] |
| 484 | A_24_P268786 | MYNN | TGGAGAGGATCATACTTTGAGTGAACAGGAATTCCATACAAAAAAGTCCTTTATCAGAAAC | SEQ ID NO: 1352 | Homo sapiens myoneurin (MYNN), mRNA [NM_018657] |
| 485 | A_24_P268917 | RAB33B | CCCAGAATCTAATGTAGTTCGGCTATTAATAACAATGGATTATTGAAAGTATATTTGAAAT | SEQ ID NO: 1353 | Homo sapiens RAB33B, member RAS oncogene family (RAB33B), mRNA [NM_031296] |
| 486 | A_24_P276583 | TMCC1 | CCTTCATTTTCTGTGTATATTCTCTGTACTATGTCGATCGACAGAACATTCAGAAGATTC | SEQ ID NO: 1354 | Homo sapiens transmembrane and coiled-coil domains 1 (TMCC1), mRNA [NM_019026] |
| 487 | A_24_P278008 | DCTN6 | CTATGAAAAGGAAGCTGAACTCCAACTTCCAAGTAAAGAACTAAGAAGACAGTGTAAAGCATGAAGATAAC | SEQ ID NO: 1355 | Homo sapiens dynactin 6 (DCTN6), mRNA [NM_006571] |
| 488 | A_24_P278460 | MLSTD2 | ACCCATGGAACAATATGCTTAGGATTACAAGGAAGCAGTCGTTAGTTACAGTTCTTGTCTG | SEQ ID NO: 1356 | Homo sapiens male sterility domain containing 2 (MLSTD2), mRNA [NM_032228] |
| 489 | A_24_P280897 | LOC388532 | AGCACTCTGAGAGCTGGGATAGGCTTCCTGAAATACATGAAGGAAAATGATCAGAAAAAGA | SEQ ID NO: 1357 | PREDICTED: Homo sapiens similar to ribosomal protein L21 (LOC388532), mRNA [XM_001127035] |
| 490 | A_24_P285179 | THC2649313 | AGTGGGAATTTTGAAATGGCATGTCCTATATATTGTGGCATATTTGTTGGCACAGATTTGCA | SEQ ID NO: 1358 | |

Fig. 3-27

| No. | Probe ID No. | Symbols of genes | Sequence | SEQ ID NO: | Descriptions of genes (letters and numbers within [ ] indicates GenBank accession No.) |
|---|---|---|---|---|---|
| 491 | A_24_P286054 | ZFYVE16 | GTGTATGTATTCTGCCATGTAAGTAATTGAACAGTCTTAAAATAACCAAATGGTAGAGGG | SEQ ID NO: 1359 | Zinc finger FYVE domain-containing protein 16 (Endofin) (Endosome- associated FYVE domain protein). [Source:Uniprot/SWISSPROT;Acc:Q7Z3T8] [ENST00000380248] |
| 492 | A_24_P287756 | NUDT21 | CCCATACTTACTTCACTTGTTATACATCACTGATTATTTGGGTTAAACTGGACTCATTTC | SEQ ID NO: 1360 | Homo sapiens nudix (nucleoside diphosphate linked moiety X)-type motif 21 (NUDT21), mRNA [NM_007006] |
| 493 | A_24_P288754 | PIGA | CTTTCTGGATACCTTAATTGTAACTGTCAGTTTGCACTGGTCGGTATATGGAAACACATT | SEQ ID NO: 1361 | Homo sapiens phosphatidylinositol glycan anchor biosynthesis, class A (paroxysmal nocturnal hemoglobinuria) (PIGA), transcript variant 1, mRNA [NM_002641] |
| 494 | A_24_P290257 | A_24_P290257 | CCAATTCATTCAACATAGAACAAGCCAATTATACCATCCAGTCATTGAAGGACACACAAGA | SEQ ID NO: 1362 | |
| 495 | A_24_P295643 | BLOC1S2 | GTTTATTTTCTATGTGAGTCAACATTGACATGCGATCCAGTTTGGGAAATGTGATGAAAACA | SEQ ID NO: 1363 | Homo sapiens biogenesis of lysosome-related organelles complex-1, subunit 2 (BLOC1S2), transcript variant 2, mRNA [NM_001001342] |
| 496 | A_24_P298238 | A_24_P298238 | ATGCTTGAAGGAAATGACATTGAGCTTGTTTGAATTCAGCAAGCCACAACAGTTAAAAAC | SEQ ID NO: 1364 | |
| 497 | A_24_P298604 | LOC731599 | GATGGAAATCATGACCAGAGGTGCGGCAAATGACTTGAAAGAATTGGTCAATAAAATGAT | SEQ ID NO: 1365 | PREDICTED: Homo sapiens hypothetical protein LOC731599 (LOC731599), mRNA [XR_015536] |
| 498 | A_24_P306527 | ENST00000308989 | ACCGACATCCGTGCGTGGTTATCCAGAAAATGTAATGAGGATGAAGATTCACCAAATAAGT | SEQ ID NO: 1366 | PREDICTED: Homo sapiens similar to ribosomal protein L3i (LOC729005), mRNA [XM_001133428] |
| 499 | A_24_P306726 | TPT1 | GACCAGAAACAAGTAAAACCTTTTATGACAGGAGCTGCAAAACAATCAAGGAGATCCTTG | SEQ ID NO: 1367 | Homo sapiens tumor protein, translationally-controlled 1 (TPT1), mRNA [NM_003295] |
| 500 | A_24_P309415 | TMEM123 | GTTTCCTCTGCATTGGGTTTGAAGTAGTTTAGTTATGTCTTTTCTCTATGTAAGTAG | SEQ ID NO: 1368 | Homo sapiens transmembrane protein 123 (TMEM123), mRNA [NM_052932] |
| 501 | A_24_P310894 | CAPZA1 | TGTATTATTTGTCCTTCATACTATCCATCGATACCACACTATCTTCTGTATCAGGTAGTC | SEQ ID NO: 1369 | Homo sapiens capping protein (actin filament) muscle Z-line, alpha 1 (CAPZA1), mRNA [NM_006135] |
| 502 | A_24_P312417 | ZBTB26 | AGAGGAGGAAGATTTTAAAAACCTTTATCATTCAGCATTTGTATTTTATGGATCCCCAGG | SEQ ID NO: 1370 | Zinc finger and BTB domain-containing protein 26 (Zinc finger protein 481) (Zinc finger protein Bioref). [Source:Uniprot/SWISSPROT;Acc:Q9HCK0] [ENST00000373656] |
| 503 | A_24_P315326 | LOC341412 | AAGCTCTATATGTTGGTTACCAATGTAGCCGTTACGGGTTCAAAAATCACAGGGCAATG | SEQ ID NO: 1371 | AGENCOURT_10640955 NIH_MGC_126 Homo sapiens cDNA clone IMAGE:6723568 5', mRNA sequence [CA452253] |
| 504 | A_24_P316074 | LOC730902 | TATCAATGGTGTGAGCCCAAAGGTCAAAGGTCGTTGCAGCTTCTTCCCTTCGTCAAATCTT | SEQ ID NO: 1372 | PREDICTED: Homo sapiens similar to 60S ribosomal protein L7 (LOC730902), mRNA [XR_015600] |
| 505 | A_24_P320328 | SUB1 | CAGAAAACCTGTAAAGAAACAAAAGACAGGTGAGACTTCGAGAGCCCTGTCATCTTCTA | SEQ ID NO: 1373 | Homo sapiens SUB1 homolog (S. cerevisiae) (SUB1), mRNA [NM_006713] |
| 506 | A_24_P321511 | GOLT1B | TTAGAGCAAGAATAGTATCTGCTAATGTAAGGAGACATCGTATTTAACTCCTTTGTAGAC | SEQ ID NO: 1374 | Homo sapiens golgi transport 1 homolog B (S. cerevisiae) (GOLT1B), mRNA [NM_016072] |
| 507 | A_24_P324224 | A_24_P324224 | AAAGCTGTCTGGCCAAAGGAATTCCTATAGGCCATGTGCGGTTGTCCAGAAAA | SEQ ID NO: 1375 | |

Fig. 3-28

| No. | Probe ID No. | Symbols of genes | Sequence | SEQ ID NO: | Descriptions of genes (letters and numbers within [ ] indicates GenBank accession No.) |
|---|---|---|---|---|---|
| 508 | A_24_P324506 | A_24_P324506 | GGAATATAAGGCAGCTAATTGCAAATACAAGTATGGCTATTTCCTGTGGACATGCTGTGT | SEQ ID NO: 1376 | |
| 509 | A_24_P324581 | KIAA1466 | ATAATAGCTCATAGAATGAATTGCTGTACCAACCAAGGCTAAAAGAATTAAGTAGCCC | SEQ ID NO: 1377 | Homo sapiens mRNA for KIAA1466 protein, partial cds. [AB040899] |
| 510 | A_24_P330397 | STRN3 | ATGGTGTAACTAAAGATTTTGTTTGTGTAATGCATGATGATTAAGACAATAAAGTATTTTTC | SEQ ID NO: 1378 | Homo sapiens striatin, calmodulin binding protein 3 (STRN3), mRNA [NM_014574] |
| 511 | A_24_P33213 | A_24_P33213 | GACCATATATTACATGGGGGTACCCAAATCTGAAGTCAGTAAATGAACTTATGTAGAAGG | SEQ ID NO: 1379 | |
| 512 | A_24_P333112 | A_24_P333112 | GGTCATCAGAATCAGAGGTATCAAGGTGTGAGCCCACAGGACCAAAAGGTATTGCAACTT | SEQ ID NO: 1380 | |
| 513 | A_24_P334361 | FLJ20035 | GTGAAAATGAAGACGAACAACGTTGTCTTAGCCTTTGAACAACTGAGTAAGACTTTTTGGG | SEQ ID NO: 1381 | Homo sapiens hypothetical protein FLJ20035 (FLJ20035), mRNA [NM_017631] |
| 514 | A_24_P33607 | LOC652558 | TAAGAAAATAATTGCTTTGACACAGAACAACGCGTTTGATTGCTGCATCTGTTGGTAAATATGG | SEQ ID NO: 1382 | PREDICTED: Homo sapiens similar to 60S ribosomal protein L7 (LOC652558), mRNA [XR_019386] |
| 515 | A_24_P349636 | LOC388401 | AGTTGCTTCGACAGATAACACTTTGATTGCTGCGATCTGTCTTGGTAAATATAGCATCAACTG | SEQ ID NO: 1383 | PREDICTED: Homo sapiens similar to 60S ribosomal protein L7 (LOC388401), mRNA [XR_016879] |
| 516 | A_24_P351435 | CRBN | GAAAGTGAAAGCAATTGGAAGACAAATGGTTCAAAGTCCTTGGTAAAAGAACAGTCAGA | SEQ ID NO: 1384 | Homo sapiens cereblon (CRBN), mRNA [NM_016302] |
| 517 | A_24_P352645 | MRPL42 | TTTTTAGTGCATGACAATCACAATGACAACAAAGGGTGGTTTTCTTTTCACCGAAGAATGTGCTTTCG | SEQ ID NO: 1385 | Homo sapiens mitochondrial ribosomal protein L42 (MRPL42), nuclear gene encoding mitochondrial protein, transcript variant 3, mRNA [NM_172178] |
| 518 | A_24_P354257 | AK025305 | GAAAAACAGATGTTTTTCTTAAGTGAAAGCAGCTTTAATTGCTCTAACGGTACATCGTG | SEQ ID NO: 1386 | Homo sapiens cDNA: FLJ21652 fis, clone COL08582. [AK025305] |
| 519 | A_24_P354412 | AK091335 | TGTAGACTGAAGGAGTCTTTCAAAACACCCCAGCATTAAATCTCACTCTGGGCTGCTCT | SEQ ID NO: 1387 | Homo sapiens cDNA FLJ34016 fis, clone FCBBF2002541. [AK091335] |
| 520 | A_24_P354954 | CCDC126 | AATGGAACCTCTGAGGAGCTTTAGCCAGGTGTATATAATAAAGGTACTTTGTCTGCTGATT | SEQ ID NO: 1388 | Homo sapiens coiled-coil domain containing 126 (CCDC126), mRNA [NM_138771] |
| 521 | A_24_P357576 | KIAA1370 | TGCTGCATATGAACTCAAATCTTACACTGAATCACCACAAAGGGTCAGTTTTCACCAAG | SEQ ID NO: 1389 | Homo sapiens KIAA1370 (KIAA1370), mRNA [NM_019600] |
| 522 | A_24_P362646 | TXNDC9 | CTCGACATTGAGGTGTAAAATAGTAGACAGACATCCTGGCAATATTGTCCAAGAAACACGT | SEQ ID NO: 1390 | Homo sapiens thioredoxin domain containing 9 (TXNDC9), mRNA [NM_005783] |
| 523 | A_24_P364807 | AYTL1 | TGTAACTCTTGTTCTAGGTAATCGTTCTGTCTGCAAGAAAAGTTCTCAGGGCGTCTGTGTAA | SEQ ID NO: 1391 | Homo sapiens mRNA; cDNA DKFZp686H22112 (from clone DKFZp686H22112). [BX641069] |
| 524 | A_24_P365048 | C17orf42 | CGGACTGAGTGGAAAAGACGCTAGTGAAGCAGTTTCTCTTCGATTCTATACTGAAGGGAT | SEQ ID NO: 1392 | Homo sapiens chromosome 17 open reading frame 42 (C17orf42), mRNA [NM_024633] |
| 525 | A_24_P366105 | LOC391126 | ACTTCGAACGAAATCAAAAATAGGCAAAAGGCATTTCAATGAATGCGTTCCACATTGCAGG | SEQ ID NO: 1393 | PREDICTED: Homo sapiens similar to 60S ribosomal protein L26 (Silica-induced gene 20 protein) (SIG-20) (LOC391126), mRNA [XR_019504] |
| 526 | A_24_P366546 | RPL31P10 | CGGCTGTCCAGAAAACGTAATGAGGATGAAGATTCAAATAAGGTCTATACTTTGGTTACC | SEQ ID NO: 1394 | PREDICTED: Homo sapiens similar to ribosomal protein L31 (LOC390283), mRNA [XR_018695] |
| 527 | A_24_P367139 | A_24_P367139 | ACACCATGAAACTGCTCAGGCCATGAAGGGCTATACATAAAAGCAAAGAAGTATCTGAAGG | SEQ ID NO: 1395 | |

Fig. 3-29

| No. | Probe ID No. | Symbols of genes | Sequence | SEQ ID NO: | Descriptions of genes (letters and numbers within [ ] indicate GenBank accession No.) |
|---|---|---|---|---|---|
| 528 | A_24_P367191 | LOC652890 | AGTTAACATGCTGAGGACTGTAAAGCCAATATATTGGCTGTGGGTACCCAAATGTGAAGTC | SEQ ID NO: 1395 | PREDICTED: Homo sapiens similar to 60S ribosomal protein L7 (LOC652890), mRNA [XR_019544] |
| 529 | A_24_P367199 | A_24_P367199 | TCTTATGGTCAGCACCACCAAGACGTGACCAAATCAAGAAGAAGGTGTAATGATGACCTGAGA | SEQ ID NO: 1397 | |
| 530 | A_24_P367369 | A_24_P367369 | ATTTAAAGGTTTCGATGTAGATTCTGTCGGTCGGAGGATATCGAAGTGAACAAAGGACTCTAA | SEQ ID NO: 1398 | |
| 531 | A_24_P371303 | C3orf63 | GTCAGTCTCAAGAAAATGAGAATTAGTTCTTATCTGCTTATACTGAAAGCTTGGATAGAG | SEQ ID NO: 1399 | Homo sapiens chromosome 3 open reading frame 63 (C3orf63), mRNA [NM_015224] |
| 532 | A_24_P374319 | RAP2C | ATTGTGTGTGATGTTGAAATAAAGTGGTATCTACATTCATGTGATTTATGGGTCAGGATG | SEQ ID NO: 1400 | Homo sapiens RAP2C, member of RAS oncogene family (RAP2C), mRNA [NM_021183] |
| 533 | A_24_P37519 | LZTFL1 | GCTAGGTAGAATTTGTACTTGTTTTCTTGGTAGGAGTTTGAAATATTCTATACAGTACG | SEQ ID NO: 1401 | Homo sapiens leucine zipper transcription factor-like 1 (LZTFL1), mRNA [NM_020347] |
| 534 | A_24_P375599 | LOC731681 | TGTATGCTCACTTCCCCGATCAAGTCGTTATCCAGAATGGGTCTCTTGTTGAAATCCGAA | SEQ ID NO: 1402 | PREDICTED: Homo sapiens similar to 60S ribosomal protein L9 (LOC731681), mRNA [XR_016944] |
| 535 | A_24_P375849 | ENST00000359659 | AAGAAGCTCTGCAACAAGACATAGACAGGCTATGTCACACATCTGATGAAGCGGATTCAGAGA | SEQ ID NO: 1403 | Q8BT90_MOUSE (Q8BT90) 10, 11 days embryo whole body cDNA, RIKEN full-length enriched library, clone:2810021H19 product:ribosomal protein S17, full insert sequence, (Fragment), partial (98%) [THC2555910] |
| 536 | A_24_P381625 | PSMC6 | ATGAAAGCAGTCAGAAAAGTGGCTGATTCTGTAAGAAGCTGGAGTCTAAATTGGACTACAAA | SEQ ID NO: 1404 | Homo sapiens proteasome (prosome, macropain) 26S subunit, ATPase, 6 (PSMC6), mRNA [NM_002806] |
| 537 | A_24_P383999 | RPS3A | TGGTTTTACTAAAAAACGGCAACAATCAGATACAGAAGACCTCTTATGCCCAGGACCAACG | SEQ ID NO: 1405 | Homo sapiens ribosomal protein S3A (RPS3A), mRNA [NM_001006] |
| 538 | A_24_P384411 | A_24_P384411 | ATGGGAAAATCAATAAGAGTCAAGAGTTTGACAGATATTGTTGACAGGTCGATCTCTTG | SEQ ID NO: 1406 | |
| 539 | A_24_P384539 | LOC730452 | CAAGAAAAGCTGGGAACTTCTATGTACCCACAAAACCGAAATTGGCATTTGTCATCAGGA | SEQ ID NO: 1407 | PREDICTED: Homo sapiens similar to 60S ribosomal protein L7 (LOC730452), mRNA [XM_001128595] |
| 540 | A_24_P387869 | PKN2 | TTGTCAGAGATCATTTATATTACGTTCGAAATTGTTTATTAGCCAAGATGCTTTGGGAG | SEQ ID NO: 1408 | Homo sapiens protein kinase N2 (PKN2), mRNA [NM_006256] |
| 541 | A_24_P389612 | ARL5B | ATTAATGCATTCACATGATCACTTCTTGAAAATGGTTCAAACGATGTTTCCTGATGGTG | SEQ ID NO: 1409 | ADP-ribosylation factor-like protein 5B (ADP-ribosylation factor-like protein 8). [Source:Uniprot/SWISSPROT;Acc:Q96KC2] [ENST00000377275] |
| 542 | A_24_P392231 | LOC641784 | CCATCAATATTCACAAGTGCATCCATGGAGTGGGCAAGAAGCGTGCCCGCTCGGGAACTCA | SEQ ID NO: 1410 | xr55h07.x1 NCI_CGAP_Ov26 Homo sapiens cDNA clone IMAGE:2764093 3' similar to gb:X69181 60S RIBOSOMAL PROTEIN L31 (HUMAN) ;, mRNA sequence [AW302767] |
| 543 | A_24_P39378 | CCPG1 | TACTTTTTGTCGGTGGAACGAACTTGATCAGTTCATCAATAAGTTTTTCCTAAACGGTGT | SEQ ID NO: 1411 | Homo sapiens cell cycle progression 1 (CCPG1), transcript variant 1, mRNA [NM_004748] |
| 544 | A_24_P393811 | TMCO1 | AGATGAGCACAGACTGTGCTTCATTTTCCTGTATATTCTGTACTATGTCGATTCG | SEQ ID NO: 1412 | Homo sapiens transmembrane and coiled-coil domains 1 (TMCO1), mRNA [NM_019026] |

Fig. 3-30

| No. | Probe ID No. | Symbols of genes | Sequence | SEQ ID NO: | Descriptions of genes (letters and numbers within [ ] indicates GenBank accession No.) |
|---|---|---|---|---|---|
| 545 | A_24_P396720 | PPP1CB | TTTCTCAACCACTACCTTCTACATTGGTTGACTTAGACCGTAAG GTTTTTAAGTTTCTC | SEQ ID NO: 1413 | Homo sapiens protein phosphatase 1, catalytic subunit, beta isoform (PPP1CB), transcript variant 1, mRNA [NM_002709] |
| 546 | A_24_P399942 | ATP11C | TGAGGATGTTAGCTAGTAGAACTGAAAAGTCATTCATTCCATATCTAC TTACAGATACACCAG | SEQ ID NO: 1414 | Homo sapiens ATPase, Class VI, type 11C (ATP11C), transcript variant 1, mRNA [NM_173694] |
| 547 | A_24_P40417 | FMR1 | TTTGTGAGTTTGTTTGTTTGAATTTTCATTTTACAGTTACTTTTGC TTGCATACAAAGAAG | SEQ ID NO: 1415 | Homo sapiens fragile X mental retardation 1 (FMR1), mRNA [NM_002024] |
| 548 | A_24_P405002 | PDIK1L | TGGTGCTAAGGATACTTTGTCATTATGATGAAGTAAGTGTTAAG TGTCAGATAAATAGC | SEQ ID NO: 1416 | Homo sapiens PDLIM1 interacting kinase 1 like (PDIK1L), mRNA [NM_152835] |
| 549 | A_24_P405298 | PPP1CB | GTATTAGGTTAGGTCACAAAGGTTTTATCTGAGGTGATTAAATA ACTTCCTGATTGGAG | SEQ ID NO: 1417 | Homo sapiens protein phosphatase 1, catalytic subunit, beta isoform (PPP1CB), transcript variant 1, mRNA [NM_002709] |
| 550 | A_24_P405430 | TIA1 | GGATTTTCTCGTTGTTTAAATCACAAAAATGATAGTCCCGAATGG TTCTTTATAGGAGG | SEQ ID NO: 1418 | Homo sapiens cDNA FLJ36425 fis, clone THYMU2011482. [AK093744] |
| 551 | A_24_P408034 | SLC35A1 | ATGTACAAGTATATTGTCCTAGCAGGATAAAGACCTAGCTCTTTC TTACAAGAGGGCAGAA | SEQ ID NO: 1419 | Homo sapiens solute carrier family 35 (CMP-sialic acid transporter), member A1 (SLC35A1), mRNA [NM_006416] |
| 552 | A_24_P409681 |  | ACATGAGCTGTCCCTGCCGCGGATTGAGATGATTCTTGAAAAGGAAC AGATGTTCATAAAC | SEQ ID NO: 1420 |  |
| 553 | A_24_P414556 | TTC33 | TACTGAACATTTGGTATATTGTTTGAGTAATGACATGGATGTTTGTTT TGTGTAATTTGTGA | SEQ ID NO: 1421 | Homo sapiens tetratricopeptide repeat domain 33 (TTC33), mRNA [NM_012382] |
| 554 | A_24_P414952 | TMEM168 | TTTTTCTACTGAAGGTCAGAGGATAGGAAACAGATATTTCTGTTCT GGTATACATTAATG | SEQ ID NO: 1422 | Homo sapiens transmembrane protein 168 (TMEM168), mRNA [NM_022484] |
| 555 | A_24_P41551 | LOC641790 | AACGAGCTGGGAACTCTCTCTGATGTGCGCATTGATATGAGGCAGAAG AAAGTACTCTGGAAA | SEQ ID NO: 1423 | PREDICTED: Homo sapiens similar to ribosomal protein L31 (LOC641790), mRNA [XR_018025] |
| 556 | A_24_P417281 | TXNDC10 | ATGATGAGTGATTCTTGGGAAGATAAATGTTAAGTGTTCCGAATAG TCAAGCTTGTTTTGC | SEQ ID NO: 1424 | Homo sapiens thioredoxin domain containing 10 (TXNDC10), mRNA [NM_019022] |
| 557 | A_24_P418418 | RPS17 | GATGAACTTCAAAATGCCTCGGCGGACCTGTTTGAATTTTTCTGC AGTGCTGTATATTTT | SEQ ID NO: 1425 | Homo sapiens ribosomal protein S17 (RPS17), mRNA [NM_001021] |
| 558 | A_24_P418712 | A_24_P418712 | AGGGTCAACAAAGCTGTCTGGGCCAAAGAATAAGGAATATATCGAT ACCATATCTGTGTTA | SEQ ID NO: 1426 |  |
| 559 | A_24_P450172 | AK095151 | TATGCACTGAATAAAGCTACTTAAACCAGAGTAATTTTGGATA TTAATCCTAAGGCTAC | SEQ ID NO: 1427 | Homo sapiens cDNA FLJ37832 fis, clone BRSSN2009630. [AK095151] |
| 560 | A_24_P487736 | CXorf23 | TGGATACCTACTATGTGTAAGAGCAAATGGATGGATTTTAAAT GAAATTTTTAGGGCGC | SEQ ID NO: 1428 | Homo sapiens chromosome X open reading frame 23 (CXorf23), mRNA [NM_198279] |
| 561 | A_24_P497226 | RPS6KB1 | TAACATTATAGCACAAGTATATCTCAGTGGATTATCCGGAATAA CATCTGAAAGATGGG | SEQ ID NO: 1429 | Homo sapiens ribosomal protein S6 kinase, 70kDa, polypeptide 1 (RPS6KB1), mRNA [NM_003161] |
| 562 | A_24_P50437 | BC065737 | TGCAGAAGAATGAAGTTGCATTTAGAAAATTCCTGATTACTGAAG ATGTTCAGGGCAAAA | SEQ ID NO: 1430 | Homo sapiens cDNA clone IMAGE:30404477, partial cds. [BC065737] |
| 563 | A_24_P50472 | LOC649839 | TAAAACTAGAAACAAGATTGTGCTGGGCGCTTGAGTGGCATTCAGCC CAACTGCAGATCCAA | SEQ ID NO: 1431 | PREDICTED: Homo sapiens similar to large subunit ribosomal protein L36a (LOC649839), mRNA [XM_001129410] |

Fig. 3-31

| No. | Probe ID No. | Symbols of genes | Sequence | SEQ ID NO. | Descriptions of genes (letters and numbers within [ ] indicates GenBank accession No.) |
|---|---|---|---|---|---|
| 564 | A_24_P50554 | LOC391655 | TGAAGGGTTTAGATGTAGATTGTGTCATTGAGTATAACCAGTAAACAAAGCACCTA | SEQ ID NO: 1432 | PREDICTED: Homo sapiens similar to 60S ribosomal protein L17 (L23) (LOC391655), mRNA [XR_018405] |
| 565 | A_24_P50567 | A_24_P50567 | CCTTGCTAATTTCAAAAAGTACGAGAACGATGAATGCAAGATGGCATGGTTGCTCTGGAGTA | SEQ ID NO: 1433 | |
| 566 | A_24_P538403 | ROCK1 | TTAGAGGTTTGTTGGACTTTGGACTTGATAAATTGAGTACAATCTTTGGATCAAACTACGTGCTAC | SEQ ID NO: 1434 | Homo sapiens Rho-associated, coiled-coil containing protein kinase 1 (ROCK1), mRNA [NM_006406] |
| 567 | A_24_P54178 | TMED5 | GCTCTGATATGCATTGGATGATTAATGTTATGCTGTTGTTCATGTGAATGTCAAGACA | SEQ ID NO: 1435 | Homo sapiens transmembrane emp24 protein transport domain containing 5 (TMED5), mRNA [NM_016040] |
| 568 | A_24_P551028 | LOC339745 | TCGAGTTGAACAAATATTGAGTGCCTATCATATGGAAGACTAACTCCTTAGTAGGAATGA | SEQ ID NO: 1436 | Homo sapiens hypothetical protein LOC339745 (LOC339745), mRNA [NM_001001664] |
| 569 | A_24_P561223 | THC2697551 | TTATGCCAGTTACATACAAGGATCGTCGCCATATTTCAGGGACCCTAAAGTTTATAACAT | SEQ ID NO: 1437 | ALU1_HUMAN (P39188) Alu subfamily J sequence contamination warning entry, partial (8%) [THC2697551] |
| 570 | A_24_P56240 | CPNE8 | TACAACTATGTGACTTAGTGCACAACACATTTGTGAAAATAACCTACTCCTATATACTGAC | SEQ ID NO: 1438 | Homo sapiens copine VIII (CPNE8), mRNA [NM_153634] |
| 571 | A_24_P56252 | AF086032 | GTATCTAAAACTGAACAGCTACTGTGCTATATTGATTTATTGGTAGTATTGAAGCAAGACC | SEQ ID NO: 1439 | Homo sapiens full length insert cDNA clone YW25G09. [AF086032] |
| 572 | A_24_P57837 | THC2567891 | AGAAATCCGGAAGAGCTCTTATGCTCAGTCAGCCAAATCGGGAAGAAGATGATGGAA | SEQ ID NO: 1440 | Q6NXR8_HUMAN (Q6NXR8) Ribosomal protein S3a, partial (91%) [THC2567891] |
| 573 | A_24_P587938 | A_24_P587938 | CTTCAAAGAAGCAAAAGCCTAATGCGGGTGAACAGGGAGGACCAGATTAACAGTCTTAT | SEQ ID NO: 1441 | |
| 574 | A_24_P606663 | LOC392030 | TGTCCGGTTGCCCAGAAGCGAAAAAGTTAATGCGGGTGAAGATTCACGAAATAAGCTCCATACTT | SEQ ID NO: 1442 | PREDICTED: Homo sapiens hypothetical LOC392030 (LOC392030), mRNA [XR_018063] |
| 575 | A_24_P62659 | TSPAN2 | CCCTTTTGGAGATAAGCTTTCCAAAATATGGTATGAGTATAAATTAGAGAATTCACCAC | SEQ ID NO: 1443 | Homo sapiens tetraspanin 2 (TSPAN2), mRNA [NM_005725] |
| 576 | A_24_P62860 | STAM2 | GTCTATATGGTACTTGATCTACATTTAAGTAGAAAAATTAGGCAGTATTTGAAAGCTCAGT | SEQ ID NO: 1444 | Homo sapiens signal transducing adaptor molecule (SH3 domain and ITAM motif) 2 (STAM2), mRNA [NM_005843] |
| 577 | A_24_P630039 | AL049321 | AACATGAGACATACAAAGTTAGATATTTGGACCATATTAAAACTGCAAGAAGACAGGGG | SEQ ID NO: 1445 | Homo sapiens mRNA; cDNA DKFZp564D156 (from clone DKFZp564D156). [AL049321] |
| 578 | A_24_P66125 | STAG2 | TAATCATTCCATGCCTTAATATGCTTGGCAATACAAGAATATGTTCAGATGGGTGAATACC | SEQ ID NO: 1446 | Homo sapiens stromal antigen 2 (STAG2), transcript variant 4, mRNA [NM_006603] |
| 579 | A_24_P675947 | ENST00000388400 | CTTCATGGCGAAGGTAGCAGTTCTGGAAAAGCTACTGGAGAAGAGACAGGTTGTAAAGTT | SEQ ID NO: 1447 | similar to 40S ribosomal protein S3a (V-fos transformation effector protein) (LOC391706), mRNA [Source:RefSeq_dna;Acc:XR_017186] [ENST00000388400] |
| 580 | A_24_P685729 | A_24_P685729 | TTGAAGTTATGTTGATGTCAAGACTATCAGTGATTATATTTGCTTTGTCTGTTTTGTGTGG | SEQ ID NO: 1448 | |
| 581 | A_24_P688133 | AK124299 | TAGGATATCGTGCAGGAAAATATCTGTTGTTAGTGATATGCCCAATAGTGATTGATTTC | SEQ ID NO: 1449 | Homo sapiens cDNA FLJ42306 fis, clone TRACH2001646. [AK124299] |

Fig. 3-32

| No. | Probe ID No. | Symbols of genes | Sequence | SEQ ID NO: | Descriptions of genes (letters and numbers within [ ] indicates GenBank accession No.) |
|---|---|---|---|---|---|
| 582 | A_24_P6975 | LOC342994 | GGAAGAGCTTCGAGGGGTTCGTGCTGTAAGAGCCTAAAGTTCTTATGAAATGTCAAAAAGA | SEQ ID NO: 1450 | PREDICTED: Homo sapiens similar to ribosomal protein L34 (LOC342994), mRNA [XM_938484] |
| 583 | A_24_P703614 | A_24_P703614 | AAGAACATTACCCGAATGGAGTCTGCAGTGTAAGTCATCAGTAGCAGCTTTGTGTGTG | SEQ ID NO: 1451 | |
| 584 | A_24_P712350 | CHML | GTGTAGAAGACTATAAAAAGGGCTTTATAAGTGATCTTTGACATAGTCACTTTGAGTGC | SEQ ID NO: 1452 | Homo sapiens choroideremia-like (Rab escort protein 2) (CHML), mRNA [NM_001821] |
| 585 | A_24_P7181 | A_24_P7181 | TCATGGTGGATTAACTCACACGTGATCTCTCCGTGCCACTCGAAATGATCTTTAGTGA | SEQ ID NO: 1453 | |
| 586 | A_24_P75158 | PTAR1 | CGATTAGATTTGTTCTTATGTGAGCATGTACCAAGCCAGCTATAAAGTATTGTATTCTG | SEQ ID NO: 1454 | Homo sapiens mRNA; cDNA DKFZp313P0917 (from clone DKFZp313P0917). [AL832683] |
| 587 | A_24_P755505 | A_24_P755505 | ATACAGAAGACCTCTTATGCTCAGGAGCAGCAACAGAGAAAAGTAAAATGCTGAAGAAGGCCAA | SEQ ID NO: 1455 | |
| 588 | A_24_P76358 | LOC643981 | TTACTGAAGATGTTCAGGGGAAAAACTGCCTAACTTCCGGCATGGATCTTATTCGTGACA | SEQ ID NO: 1456 | PREDICTED: Homo sapiens similar to 40S ribosomal protein S3a (V-fos transformation effector protein) (LOC643981), mRNA [XR_018444] |
| 589 | A_24_P77681 | PAIP1 | AGCTGATCCAGATTACCAAGAGAGAAAACTGGCTAACGAATTACTTGAAAGAGAGGAACTTTTTCC | SEQ ID NO: 1457 | Homo sapiens poly(A) binding protein interacting protein 1 (PAIP1), transcript variant 1, mRNA [NM_006451] |
| 590 | A_24_P781846 | AK024092 | ACTTTTTATAGATACAAATGTATCGTGGTAGTACAAGGACTTTGTTACTTGGCGTGG | SEQ ID NO: 1458 | Homo sapiens cDNA FLJ14030 fis, clone HEMBA1004086. [AK024092] |
| 591 | A_24_P792734 | PSMC6 | AGAACGTTAACGGAGTTACTGAATCAAATGATGGATTTGATACTCTGCATAGAGTTAAA | SEQ ID NO: 1459 | Homo sapiens proteasome (prosome, macropain) 26S subunit, ATPase, 6 (PSMC6), mRNA [NM_002806] |
| 592 | A_24_P795230 | AK027541 | ACAAGTTCTAGGAGTTTGAACTTTGGGTCAAGATGTTGATTCGTTTTAATGTGCGAGGGT | SEQ ID NO: 1460 | Homo sapiens cDNA FLJ14635 fis, clone NT2RP2001196. [AK027541] |
| 593 | A_24_P80915 | BCLAF1 | AACTGTGTGCAATGATGGTAATGAGACAAAACTTGTACATTTAATTAAGGTACCAGTTG | SEQ ID NO: 1461 | Homo sapiens BCL2-associated transcription factor 1 (BCLAF1), transcript variant 1, mRNA [NM_014739] |
| 594 | A_24_P81865 | RAP2A | TTCTTTGATGTTGCAACTTGGGTTGCTTTAAACGTGATAGTGATGGTAACTGATGC | SEQ ID NO: 1462 | Homo sapiens RAP2A, member of RAS oncogene family (RAP2A), mRNA [NM_021033] |
| 595 | A_24_P82630 | SMCHD1 | TGTTTAATATGTAACACGTAAGAACAATTGAAATTTCTTCTAAGATTTAATTACTAGTGT | SEQ ID NO: 1463 | Homo sapiens mRNA for KIAA0650 protein, partial cds. [AB014550] |
| 596 | A_24_P83968 | LOC730887 | ACAAAGCCAGCAGAACAACGTGGAACACAGAGAAACTTTTCTGGTGTCTGTAAGAAGC | SEQ ID NO: 1464 | PREDICTED: Homo sapiens similar to 40S ribosomal protein S7 (S8) (LOC730887), mRNA [XR_015607] |
| 597 | A_24_P84408 | AK027541 | AAGGTAGATCCAGGAGGTGGTCATTGACAAGTCATACAGAGAGAAAAGATGGCGTGTTTCTT | SEQ ID NO: 1465 | |
| 598 | A_24_P84808 | LOC729449 | GAATTGCTTTGAGACGATAAGGCTTTGGATGTCTTGGGAAAATATGGCATATCGTATGG | SEQ ID NO: 1466 | PREDICTED: Homo sapiens similar to 60S ribosomal protein L7 (LOC729449), mRNA [XR_015548] |
| 599 | A_24_P850187 | A_24_P850187 | TAAATGAACTAATCTACAAGCGTGCTTATGGCAAAATCAATTGACTTGCACTTTCGTAC | SEQ ID NO: 1467 | |
| 600 | A_24_P859859 | THC2553238 | TTTAACCAGACAGTCTGCACCCTTTTTCCTGATACTGTGAGGACACTCGGTCTCTAGCAAT | SEQ ID NO: 1468 | 1305349A cystic fibrosis antigen. [Homo sapiens] (exp=-1; wgp=0; cg=0), partial (65%) [THC2553238] |
| 601 | A_24_P867201 | AK022997 | GTGACATGTGATAAATATTTCAGTGACTTTTCAGAGATTTATTTCTTGTTAGCCGCTGTGTC | SEQ ID NO: 1469 | Homo sapiens cDNA FLJ12935 fis, clone NT2RP2004982. [AK022997] |

Fig. 3-33

| No. | Probe ID No. | Symbols of genes | Sequence | SEQ ID NO: | Descriptions of genes (letters and numbers within [ ] indicates GenBank accession No.) |
|---|---|---|---|---|---|
| 602 | A_24_P886040 | DCP2 | CATTTGGAAGAAGGTTTCATTCTGTTTCTAGATTTATGTGTTGTAGTTGAAGAACGAAGTG | SEQ ID NO: 1470 | Homo sapiens DCP2 decapping enzyme homolog (S. cerevisiae) (DCP2), mRNA [NM_152624] |
| 603 | A_24_P880636 | CR627148 | AATTGCCTTCCTTGTAACCCTAAGTATGCTGAAGACAGAATTGAATTCTACAAAGTCTTTC | SEQ ID NO: 1471 | Homo sapiens mRNA; cDNA DKFZp779F2127 (from clone DKFZp779F2127). [CR627148] |
| 604 | A_24_P91852 | DYNLT3 | ATACATATAGAGAGAGGAACCATAACTCATTGAATTTGGAGAGGAATAAGCTTAGCGTT | SEQ ID NO: 1472 | Homo sapiens dynein, light chain, Tctex-type 3 (DYNLT3), mRNA [NM_006520] |
| 605 | A_24_P91916 | NXT2 | AAGGATGCTTTCTTCTGTAGTACTGATTGAAACTTACACGTTTTATTCTACTCATAGTGAGC | SEQ ID NO: 1473 | Homo sapiens nuclear transport factor 2-like export factor 2 (NXT2), mRNA [NM_018698] |
| 606 | A_24_P931282 | THC2726401 | GGAAATATTTCTCCTCTCAAATGCATGAAATCATGATTGAGGTAATCTTACTGGAGATTACAC | SEQ ID NO: 1474 | Q26195 PLAV1 (Q26195) Pval protein, partial (14%) [THC2726401] |
| 607 | A_24_P935886 | BCAT1 | ATGTCTTGAAGGTTTTCTAGAAGCAGAATTAAACATCATAAATGACTTTGTTACACCAGA | SEQ ID NO: 1475 | Homo sapiens branched chain aminotransferase 1, cytosolic (BCAT1), mRNA [NM_005504] |
| 608 | A_24_P937095 | SLC30A1 | TTTGATGTAGGTCTACGGATACGTATGTGGTAATGCTATTTTGTTTTACTAACAAGGTCTG | SEQ ID NO: 1476 | Zinc transporter 1 (ZnT-1) (Solute carrier family 30 member 1). [Source:Uniprot/SWISSPROT;Acc:Q9Y6M5] [ENST00000367100] |
| 609 | A_24_P940426 | QKI | AAGCTGTTGAATGAGTCTTATAAAATTATACTACTGTTAAGTGGACCAAGTTTGGTGAAGC | SEQ ID NO: 1477 | Homo sapiens quaking homolog, KH domain RNA binding (mouse) (QKI), transcript variant 4, mRNA [NM_206855] |
| 610 | A_24_P940725 | C6orf111 | AATTATGATTAGTGAGTGGTCTAACAGTTAAGGGCATTGATAAGTTACAAGTAGAGTGGG | SEQ ID NO: 1478 | Splicing factor, arginine/serine-rich 130 (Serine-arginine-rich- splicing regulatory protein 130) (SRrp130) (SR-rich protein) (SR-related protein). [Source:Uniprot/SWISSPROT;Acc:O8TF01] [ENST00000369239] |
| 611 | A_24_P940776 | BDP1 | TCGGAGGCGGAAAATTGTCTATAAGTAGGCATTTATTCATGATTGATATGTCAAGAAATC | SEQ ID NO: 1479 | Homo sapiens B double prime 1, subunit of RNA polymerase III transcription initiation factor IIIB (BDP1), mRNA [NM_018429] |
| 612 | A_24_P941643 | PLCB1 | ATGATCTGCAGTTTTGTGCCTTTATGTATTGGGTTGTTCTTTGTCGAATGTGTGAAATT | SEQ ID NO: 1480 | Homo sapiens phospholipase C, beta 1 (phosphoinositide-specific) (PLCB1), transcript variant 2, mRNA [NM_182734] |
| 613 | A_24_P941699 | PCGF5 | TGGTATATTGAAGTACACAGCTTTCTAAGGATGGACTACTTTCATGTCTAGTAATACAGTG | SEQ ID NO: 1481 | Homo sapiens polycomb group ring finger 5 (PCGF5), mRNA [NM_032373] |
| 614 | A_24_P944458 | INSIG2 | ATGTATTCGTGTATCCATTAGTGAATAGTTCAAGTCTGTTAAGAGTGTATTGAGATGGC | SEQ ID NO: 1482 | Homo sapiens insulin induced gene 2 (INSIG2), mRNA [NM_016133] |
| 615 | A_24_P95029 | TAX1BP1 | TGCTTTGATTCCAGCTTTGATGTTCACAGAAGAAGTGCCCCTCGTGAGTTAATGTTTCCT | SEQ ID NO: 1483 | Homo sapiens Tax1 (human T-cell leukemia virus type I) binding protein 1 (TAX1BP1), transcript variant 1, mRNA [NM_006024] |
| 616 | A_24_P99046 | STK38L | GCTATCTGTCTTTTGCTGATCTACAAATAAATGAATTGAGAATTTAGTGCATAGAGGTCG | SEQ ID NO: 1484 | Homo sapiens serine/threonine kinase 38 like (STK38L), mRNA [NM_015000] |
| 617 | A_32_P10100 | A_32_P10100 | TATGAGGAAATAGTATCATCATGTTAGAAGCCTTGGAATGAGTATAAATAATGGCTGGTC | SEQ ID NO: 1485 | |

Fig. 3-34

| No. | Probe ID No. | Symbols of genes | Sequence | SEQ ID NO: | Descriptions of genes (letters and numbers within [ ] indicates GenBank accession No.) |
|---|---|---|---|---|---|
| 618 | A_32_P10424 | AX721252 | AAATTGTCAGGAAGGAGATGGGAACTCTAGATGTGCAAAGTGATACCAGGCTGAACAA | SEQ ID NO: 1486 | Sequence 212 from Patent WO0220754. [AX721252] |
| 619 | A_32_P105397 | THC2642694 | TAAAATGCTACTACAGTATTCTAGGATGGAGGCTGAATGTATATTACAGTAATTCTCTGG | SEQ ID NO: 1487 | Q6TDT1_HUMAN (Q6TDT1) Protein transactivated by hepatitis B virus E antigen, partial (11%) [THC2642694] |
| 620 | A_32_P106732 | FANCM | AATGAAGCTGCTCAAGATGGGGTTTCAAAGACCTCACACATATTAAATGCAGTTCAT | SEQ ID NO: 1488 | Homo sapiens Fanconi anemia, complementation group M (FANCM), mRNA [NM_020937] |
| 621 | A_32_P107372 | GBP1 | GGTACTGAGCAGCAAGTCTTAGGTAAAAGTCTTGGGAAATATTTGGGCATTGGTCTGGCCAA | SEQ ID NO: 1489 | Homo sapiens guanylate binding protein 1, interferon-inducible, 67kDa (GBP1), mRNA [NM_002053] |
| 622 | A_32_P109522 | C6orf113 | TAGAGGGTGGTCTTTCTCTAGAAGGAGAAACTTGGCAGGAGGACAAAGCTTGTCAAGTCTTTA | SEQ ID NO: 1490 | Homo sapiens chromosome 6 open reading frame 113 (C6orf113), mRNA [NM_145062] |
| 623 | A_32_P113154 | LOC730861 | ACCACGAGTCCAAGAATCTGTTTAAAGTTCAGAGTTAAAAGAGTACCAAATAAAAGTCC | SEQ ID NO: 1491 | PREDICTED: Homo sapiens similar to 40S ribosomal protein S3a (V-fos transformation effector protein) (LOC730861), mRNA [XR_015591] |
| 624 | A_32_P113584 | ZNF292 | GGGCCTTTTGGGTTTTATTGAATAGTTCATTTCACGTGTTAAGACTTACTACCAATAAG | SEQ ID NO: 1492 | Zinc finger protein 292. [Source:Uniprot/SWISSPROT;Acc:O60281] [ENST00000339907] |
| 625 | A_32_P114215 | COMMD6 | AATTGGTATCATTCTAAAGTCATGAGTTGAGTTTGGGGAACAAAACTAAATAAGGATGG | SEQ ID NO: 1493 | Homo sapiens COMM domain containing 6 (COMMD6), transcript variant 2, mRNA [NM_203495] |
| 626 | A_32_P1144 | AK091357 | GGGACTTAATATTTACATGTTACTACGTGTCATAGGTTTTAAGTGCTTTAATGGGG | SEQ ID NO: 1494 | Homo sapiens cDNA FLJ34038 fis, clone FCBBF2005645. [AK091357] |
| 627 | A_32_P11451 | NMD3 | CAGTTTAGGGCAGTAGCTGCTTTTGTCATAAATATCTTCCTACCAGATCAAAATGCTGG | SEQ ID NO: 1495 | Homo sapiens NMD3 homolog (S. cerevisiae) (NMD3), mRNA [NM_016938] |
| 628 | A_32_P115505 | ZNF294 | TGTGGTCAGAGGATTATAGTTGAAGAGTGAAGTACTATGTGTGAGTTATAGATCTCTGGAA | SEQ ID NO: 1496 | Homo sapiens zinc finger protein 294 (ZNF294), mRNA [NM_015565] |
| 629 | A_32_P11931 | LOC441073 | GTGTGATCCATGCCCATCGGAAAGGAAGGATGATGAAGTTCAGGTTGTACGTGAACATATAAA | SEQ ID NO: 1497 | PREDICTED: Homo sapiens similar to 60S ribosomal protein L26 (Silica-induced gene 20 protein) (SIG-20) (LOC441073), mRNA [XR_016376] |
| 630 | A_32_P12430 | SPG20 | TCAGGGTAAAGAATATGAAAACCTTAGACGTAATCCATGGTGGATAGGCATTATGGTTTC | SEQ ID NO: 1498 | Homo sapiens spastic paraplegia 20, spartin (Troyer syndrome) (SPG20), mRNA [NM_015087] |
| 631 | A_32_P124580 | THC2610143 | ATTAGCTGGGACTAAAACGGCAGATGTTTGTTTTGTGAATTGTACCTAAATGTCTCTA | SEQ ID NO: 1499 | AA490192 aa43f10.r1 Soares_NhHMPu_S1 Homo sapiens cDNA clone IMAGE:823723 5', mRNA sequence [AA490192] |
| 632 | A_32_P125549 | RPL31P4 | TCTACAGACAGTCAACATGTGGATGGAGAACTAATCCCTGATCGTCAGATACTGAAATAAAG | SEQ ID NO: 1500 | PREDICTED: Homo sapiens ribosomal protein L31 pseudogene 4 (RPL31P4), mRNA [XR_018222] |
| 633 | A_32_P125917 | THC2753798 | GCTTATAAAGTGTAAGTGGAGAGCGCTAAATTGTGAGTACAAAGTTTCTTTTCACAAGAG | SEQ ID NO: 1501 | BF238843 601904455F1 NIH_MGC_54 Homo sapiens cDNA clone IMAGE:4132429 5', mRNA sequence [BF238843] |
| 634 | A_32_P128781 | A_32_P128781 | CATATATTGCATGGGGTACCCCAATCTGAAGTCAGTAAATGAACTAATCTACAAGAGTG | SEQ ID NO: 1502 | |
| 635 | A_32_P128980 | BC062780 | AGATGGGAGGACAGAGGAAGTAGTGACAAGGAGTAGAAGCACTGTAGACGTTTTCATATCAT | SEQ ID NO: 1503 | Homo sapiens cDNA clone IMAGE:4700531, partial cds. [BC062780] |

Fig. 3-35

| No. | Probe ID No. | Symbols of genes | Sequence | SEQ ID NO: | Descriptions of genes (letters and numbers within [ ] indicates GenBank accession No.) |
|---|---|---|---|---|---|
| 636 | A_32_P135818 | RPS3A | CTTGCTTCATCTGTTCTGTATTGGTTTTAATAAAAACGGAACAATCAGATATGGAAGAC | SEQ ID NO: 1504 | Homo sapiens ribosomal protein S3A (RPS3A), mRNA [NM_001006] |
| 637 | A_32_P136319 | RPL36A | AAGTGATCCAGTTCTAAGTGTCATCTTTTATCATGAAGACAACAAAATCTTGAGTTTATG | SEQ ID NO: 1505 | Homo sapiens ribosomal protein L36a (RPL36A), mRNA [NM_021029] |
| 638 | A_32_P137266 | KIAA1799 | AAGTGGGACCCAAATCTACAAGTCTTTGTCAACATGTAATGGCTTTGAATGAACGACAAG | SEQ ID NO: 1506 | Homo sapiens KIAA1799 protein (KIAA1799), mRNA [NM_032437] |
| 639 | A_32_P143323 | CR613267 | AGAGAGCTCAAACAATGAGGGTTTATGGCAGTTACATACAAGGATCCTGCATATTTCAGGG | SEQ ID NO: 1507 | full-length cDNA clone CS0DL011YP14 of B cells (Ramos cell line) Cot 25-normalized of Homo sapiens (human) [CR613267] |
| 640 | A_32_P145153 | RPL31 | ATCCGTGTCTGGAGCTGTCCAAGAAAACGTAATGAGGATGAAGAATTCACCAAATAAGCACATAT | SEQ ID NO: 1508 | Homo sapiens ribosomal protein L31 (RPL31), mRNA [NM_000993] |
| 641 | A_32_P145159 | A_32_P145159 | CATACATTGGCGTGTGTACATAAACGTTTGTGGAAAAACTTAGTGTGTGATTATTCTCTTTG | SEQ ID NO: 1509 | |
| 642 | A_32_P147747 | THC2575761 | TTGATACCTGTCTGATTCTGATGACAAAGCGCAATTTGGGGTCTGGCAGGTACATAGAAGTTG | SEQ ID NO: 1510 | HUMRPL7Y ribosomal protein L7 [Homo sapiens] (exp=-1; wgp=0; cg=0), partial (40%) [THC2575761] |
| 643 | A_32_P148824 | C1orf27 | GAAAAACAGATGTATCCTCAGCACAGAAATTCAGTAAAGAGACTACAAAAGGATGATCTTC | SEQ ID NO: 1511 | Homo sapiens chromosome 1 open reading frame 27 (C1orf27), mRNA [NM_017847] |
| 644 | A_32_P1516 | AA714537 | CTGAGGATAAAGAGGGTCTTCCGTATCTGATTTTTTAGTAAAAAGCAACACAGAA | SEQ ID NO: 1512 | nw20g12.s1 NCI_CGAP_GCB0 Homo sapiens cDNA clone IMAGE:1241062 3' similar to gb:M84711 40S RIBOSOMAL PROTEIN S3A (HUMAN); mRNA sequence [AA714537] |
| 645 | A_32_P153726 | KIAA1033 | TTTTTAAAAGATGGCAAGTTTGTTACGTCACGTCACTGAGTGGGGTTTTCGTTTTCGGGCAAT | SEQ ID NO: 1513 | Homo sapiens KIAA1033 (KIAA1033), mRNA [NM_015275] |
| 646 | A_32_P155364 | RPL7 | TCAACAGGGCTTATTAGAAAATGAACCAAGGTGTCTACCATGATAATTTTCTAAGGTGG | SEQ ID NO: 1514 | Homo sapiens ribosomal protein L7 (RPL7), mRNA [NM_000971] |
| 647 | A_32_P156811 | CD2AP | AAAGGATGGTTCTCTCTCAAAAAGAAAATTAAAGGATTTTATTGCCAGTCGTGTCAGTC | SEQ ID NO: 1515 | Homo sapiens CD2-associated protein (CD2AP), mRNA [NM_012120] |
| 648 | A_32_P158746 | RPL17 | TTTTGCTGCACATGCTAAAAATGCAGAGAGTAATGGTGAACTTAAGGGTTTAGATGTAG | SEQ ID NO: 1516 | Homo sapiens ribosomal protein L17 (RPL17), transcript variant 1, mRNA [NM_000985] |
| 649 | A_32_P159651 | PCAF | GAGTGGTGTCTAGATTTCTAATGAAGAATCATGATACAGTTTGGATTAAGTATCTTGGAC | SEQ ID NO: 1517 | Homo sapiens p300/CBP-associated factor (PCAF), mRNA [NM_003884] |
| 650 | A_32_P162150 | MAP3K7IP3 | AGGGATAGAAGAATTGTCCTCTAAAAATATCAATGATGTATCCTGGAATGTGAAGATGTC | SEQ ID NO: 1518 | Homo sapiens mitogen-activated protein kinase kinase kinase 7 interacting protein 3 (MAP3K7IP3), mRNA [NM_152787] |
| 651 | A_32_P164203 | THC2683448 | TTGATGGTCATTGTACGAGCTATTGTATGGATTACTGGTGGAGTGCTGTTTAGCACATGAT | SEQ ID NO: 1519 | Q7WZG3_PASP1 (Q7WZG3) Ferric uptake regulator, partial (8%) [THC2683448] |
| 652 | A_32_P167122 | RCOR3 | GTATCTGAGGGATGTGCTGTAATCTGATTTAGATGCATTAGAGCACACAGTAGAAAAACT | SEQ ID NO: 1520 | Homo sapiens REST corepressor 3 (RCOR3), mRNA [NM_018254] |
| 653 | A_32_P170444 | SUB1 | TAGGTATCTCTCCTGAAATTCTTTGCAGTTCATTTTTATGGCAGTTAATGCAGTGAAAC | SEQ ID NO: 1521 | Activated RNA polymerase II transcriptional coactivator p15 (SUB1 homolog) (Positive cofactor 4) (PC4) (p14). [Source:Uniprot/SWISSPROT;Acc:P53999] [ENST00000265073] |

Fig. 3-36

| No. | Probe ID No. | Symbols of genes | Sequence | SEQ ID NO: | Descriptions of genes (letters and numbers within [ ] indicates GenBank accession No.) |
|---|---|---|---|---|---|
| 654 | A_32_P170736 | AK098422 | AGGTCATAATTGTTGAGGGCAAGGCTTGATTGTTGATAGTGCAAAGTGTCGCTGTTGTGAT | SEQ ID NO:1522 | Homo sapiens cDNA FLJ25556 fis, clone JTH02629. [AK098422] |
| 655 | A_32_P172578 | THC2661509 | ACTTAATGAATGTCTCAAAGATTTCTAGGGATTCTCCATCTCATGCATTCCTTGTGTTCC | SEQ ID NO:1523 | |
| 656 | A_32_P173385 | ENST00000334683 | AAATGCAGAGAGTGATGCTGAACTTAAGGGTGTCAGATGTAGAATTCTCTGGTCATTGAGCA | SEQ ID NO:1524 | PREDICTED: Homo sapiens similar to 60S ribosomal protein L17 (L23) (LOC650948), mRNA [XR_019013] |
| 657 | A_32_P176819 | CMAH | GATTATATATGGTAGGTGTGATTCTGAAGATACAAGAATTCAATGGTGGAATTTGTCTCC | SEQ ID NO:1525 | Homo sapiens cytidine monophosphate-N-acetylneuraminic acid hydroxylase (CMP-N-acetylneuraminate monooxygenase) (CMAH) on chromosome 6 [NR_002174] |
| 658 | A_32_P177040 | WBSCR19 | AATCTTTGTATGTATTATTACACGTCGTTGCTGAAGGGAGCATGGTTTTATCTGTGATAC | SEQ ID NO:1526 | Homo sapiens Williams Beuren syndrome chromosome region 19 (WBSCR19), mRNA [NM_175064] |
| 659 | A_32_P177953 | GCLM | ATTTATTGTATGTTGGCTAGCAGTTCATCCTCTGCAAAATATGCATTCAGAGAAATGTG | SEQ ID NO:1527 | Glutamate—cysteine ligase regulatory subunit (EC 6.3.2.2) (Gamma-glutamylcysteine synthetase) (Gamma-ECS) (GCS light chain) (Glutamate—cysteine ligase modifier subunit). [Source:Uniprot/SWISSPROT;Acc:P48507] [ENST00000370238] |
| 660 | A_32_P179966 | ENST00000379426 | GTAATATACAGGGTGAACTCTTACTGATACACACAAGAACAAGTGTTAAAAAGTGAATCG | SEQ ID NO:1528 | Novel protein. [Source:Uniprot/SPTREMBL;Acc:Q5T4T1] [ENST00000379426] |
| 661 | A_32_P180435 | WBSCR19 | CTTTGAATGTTGTATCATATTATTACACGGTGCTGCTGCTGAAGGGAGGATGTTTTATCTATG | SEQ ID NO:1529 | Homo sapiens Williams Beuren syndrome chromosome region 19 (WBSCR19), mRNA [NM_175064] |
| 662 | A_32_P186981 | RPL17 | CATTGAGATGATCCTTACGGGAAAAGGAACAGATTGTTCCTAAACGAGAAGGAAGGTTGC | SEQ ID NO:1530 | Homo sapiens ribosomal protein L17 (RPL17), transcript variant 1, mRNA [NM_000985] |
| 663 | A_32_P190488 | hCG_26523 | CCCAGGCAAGGTGGTTACACTAGGCTAAAACTGGACAAAGACCGCAAAAGATCCTTGAA | SEQ ID NO:1531 | PREDICTED: Homo sapiens similar to 60S ribosomal protein L26 (LOC646161), mRNA [XR_018048] |
| 664 | A_32_P193322 | RICTOR | ACCACATGAGTTTGTTCTTTTATTTAGTAATAACGCTGCTACATATTTGGAGGTTCTGG | SEQ ID NO:1532 | Homo sapiens rapamycin-insensitive companion of mTOR (RICTOR), mRNA [NM_152756] |
| 665 | A_32_P195587 | DKFZP779L1068 | ATATAACCTTGGAATTCTATTCTAATTATGTTGTTCTGGCTGCTTGTAGTATCAGTTCGC | SEQ ID NO:1533 | Homo sapiens cDNA clone IMAGE:5555490. [BC110326] |
| 666 | A_32_P196483 | RPS3A | GGGGCAAGAAGAAGATGGTTGATCGATTTTTCTAAGGAAAGATTGGTATGATGTGAAAGCA | SEQ ID NO:1534 | Homo sapiens ribosomal protein S3A (RPS3A), mRNA [NM_001006] |
| 667 | A_32_P19752 | FAM76B | TTGTGCTTTTAGCGTGTTTCCAGTATTATTAATTAGCAGTAAGGGTCATTTTGACAAGAGA | SEQ ID NO:1535 | Homo sapiens family with sequence similarity 76, member B (FAM76B), mRNA [NM_144664] |
| 668 | A_32_P20240 | SP3 | CTTAGGCTCTTAATTGTTGTAGTTTAAATTCCAGTACTGCCTACTCAGACCCAAAAGTTTGT | SEQ ID NO:1536 | Homo sapiens mRNA; cDNA DKFZp686N17231 (from clone DKFZp686N17231). [BX648577] |
| 669 | A_32_P202488 | RPL21 | AAGAGGAGAGCCACCGATATATGTCTGTAGGCGTTTTTAAAAACATGGCAATGGGTAC | SEQ ID NO:1537 | Homo sapiens ribosomal protein L21, mRNA (cDNA clone IMAGE:6605332), complete cds. [BC104478] |
| 670 | A_32_P203320 | ROCK1 | AACGGCCATCACTATCAAGATCAGGCTCAGGAAGAGTAAAGAAAATATCAAATGAG | SEQ ID NO:1538 | Homo sapiens Rho-associated, coiled-coil containing protein kinase 1, mRNA (cDNA clone IMAGE:5269992), complete cds. [BC041849] |

Fig. 3-37

| No. | Probe ID No. | Symbols of genes | Sequence | SEQ ID NO: | Descriptions of genes (letters and numbers within [ ] indicates GenBank accession No.) |
|---|---|---|---|---|---|
| 671 | A_32_P20367 | RPS7 | ATCCTTGAGGACTTGGTCTTCACAAGGAAATTGTGGGGAAGAGAATCCGGCGTGAAACTA | SEQ ID NO: 1539 | Homo sapiens ribosomal protein S7 (RPS7), mRNA [NM_001011] |
| 672 | A_32_P204330 | AK093982 | AAACCGTGAAGCTTTTTGCTCGTCTTGGTAGCAGATATCTGTAAAACCTACCCAGAATTG | SEQ ID NO: 1540 | Homo sapiens cDNA FLJ36663 fis, clone UTERU2002826. [AK093982] |
| 673 | A_32_P205550 | RPL26L1 | AGGTAGTTCAGGACACTACAAAGGTCAGGAAATTGGCAAGGTAATCCAGGTGTACAAGA | SEQ ID NO: 1541 | Homo sapiens ribosomal protein L26-like 1 (RPL26L1), mRNA [NM_016093] |
| 674 | A_32_P205553 | RPL26L1 | TTCGGAATGTGTGGAACATTTCATTCGTGTTTGTTACCTGTGGCTCTGTAAATCTACT | SEQ ID NO: 1542 | Homo sapiens ribosomal protein L26-like 1 (RPL26L1), mRNA [NM_016093] |
| 675 | A_32_P207231 | AI630435 | TTCCTTCGCTTTTTTCTTAAGGGTTTCGTGGAACAGGAGGAAACCTCCTTCTTCTTCTTCT | SEQ ID NO: 1543 | AI630435 ad10b05.y1 Hembase; Erythroid Progenitor Cells (LCB:ad library) Homo sapiens cDNA clone ad10b05 random. mRNA sequence [AI630435] |
| 676 | A_32_P208178 | RPS3A | GGAAAAGACGTAGAAAAGGCTTGGCAATCGTATTTATCGTCTCGGATGATGTCTTCGTTAGA | SEQ ID NO: 1544 | Homo sapiens ribosomal protein S3A (RPS3A), mRNA [NM_001006] |
| 677 | A_32_P21384 | RPL17 | AGATGTCACTTTAGAGAAGAAACAGTGTGTACCATTCGGACATTACAACGGTGGGAGTTGGCAG | SEQ ID NO: 1545 | Homo sapiens ribosomal protein L17 (RPL17), transcript variant 1, mRNA [NM_000985] |
| 678 | A_32_P220127 | RPL34 | CAAAACTAGGCGTGTCCTGAACCCGTCCTGGTAATAGAATTGTTGACCTTTATACCAAGAGGT | SEQ ID NO: 1546 | Homo sapiens ribosomal protein L34 (RPL34), transcript variant 2, mRNA [NM_033625] |
| 679 | A_32_P223319 | ESCO1 | ATGCCGTCATTACTGGACTTGCATTTTGATACTGTCGTCTATCGTTCATAGTGCCGTCGTACTT | SEQ ID NO: 1547 | Homo sapiens establishment of cohesion 1 homolog 1 (S. cerevisiae) (ESCO1), mRNA [NM_052911] |
| 680 | A_32_P224666 | CAPZA2 | AATGCTGTTTTTGAGATTCTGAAATTAAATGAAAATACTTATTTGAGAAATGCATTTAATG | SEQ ID NO: 1548 | Homo sapiens capping protein (actin filament) muscle Z-line, alpha 2 (CAPZA2), mRNA [NM_006136] |
| 681 | A_32_P22539 | hCG_28523 | ACTACGAAGGTCAGCAAGTTGGCAAATGGTCCAGGTTTACAGGAAAGAAATATGTTATGT | SEQ ID NO: 1549 | PREDICTED: Homo sapiens similar to 60S ribosomal protein L26 (Silica-induced gene 20 protein) (SIG-20) (LOC400065), mRNA [XM_374987] |
| 682 | A_32_P226786 | BC045174 | TTATTGGTGCATGTAAGCAATTATGCTGTCTTAATGAACCGATTAATGCTGTTGATTGTT | SEQ ID NO: 1550 | Homo sapiens cDNA clone IMAGE:5273245. [BC045174] |
| 683 | A_32_P2333 | SUB1 | AGGAAGAAAAGGTATTTCTTAAATCAGAAGAAATGGAGGCGAGCTGACAGAACAGATTTC | SEQ ID NO: 1551 | Homo sapiens SUB1 homolog (S. cerevisiae) (SUB1), mRNA [NM_006713] |
| 684 | A_32_P233304 | LIN9 | AAAGCTTCCGTATTCTTTGTTGTATTGTGCCACTGCAGAACTTTAGTGCAGAGTTTAT | SEQ ID NO: 1552 | Homo sapiens lin-9 homolog (C. elegans) (LIN9), mRNA [NM_173083] |
| 685 | A_32_P233314 | EXOC8 | AGGATTGGGAATTTGGACATGACATGTACTATAAAAGTCAGTCTATGCATACTGCTT | SEQ ID NO: 1553 | Homo sapiens exocyst complex component 8 (EXOC8), mRNA [NM_175876] |
| 686 | A_32_P234738 | RPL21 | GTTCTAAACAAAGAAGTTAAGGGGAAGATTCTTGCAAGAGAATTAATGTGCGTATTGAG | SEQ ID NO: 1554 | Homo sapiens ribosomal protein L21 (RPL21), mRNA [NM_000982] |
| 687 | A_32_P26895 | KIAA1600 | AATTCTTGGTCCCTGCGTGGAGAAAACTCTCAGATGGTCATTGTGTACCTACTCTCTCTT | SEQ ID NO: 1555 | KIAA1600 (KIAA1600), mRNA [Source:RefSeq_dna;Acc:NM_020940] [ENST00000369248] |
| 688 | A_32_P30710 | RPL23 | ACGAAAGTCATACCGGTAGAAAAGATGGCGTGTTTCTTTATTTTGAAGATAATGCAGGAGT | SEQ ID NO: 1556 | Homo sapiens ribosomal protein L23 (RPL23), mRNA [NM_000978] |
| 689 | A_32_P31182 | RPL7 | GTAGAAGAGAAGAAGGTTCCTGCTGTGCAGAAACCCTTAAGAAAAGGAAGGAAT | SEQ ID NO: 1557 | Homo sapiens ribosomal protein L7 (RPL7), mRNA [NM_000971] |

Fig. 3-38

| No. | Probe ID No. | Symbols of genes | Sequence | SEQ ID NO: | Descriptions of genes (letters and numbers within [ ] indicates GenBank accession No.) |
|---|---|---|---|---|---|
| 690 | A_32_P3742 | RFX3 | CCTCTGAAAATTGGCAGGAGGCTAAATAATAGTTTGTGGGCGGATTTGTATTGTGTACTGTA | SEQ ID NO: 1558 | Transcription factor RFX3. [Source:Uniprot/SWISSPROT:Acc:P48380] [ENST00000382004] |
| 691 | A_32_P43217 | PSMA6 | TTGTTGTTAGTTACCAGATCCGTGATGCCACTTACCTGCTGTGTTTGGTAACAACAAACA | SEQ ID NO: 1559 | Homo sapiens proteasome (prosome, macropain) subunit, alpha type, 6 (PSMA6), mRNA [NM_002791] |
| 692 | A_32_P4532 | LOC643932 | GATTCCAGACAGCAGGATTGGAAAAGACATAGAAAAGGCTTGCCATCTATCGTCTCCATGAT | SEQ ID NO: 1560 | PREDICTED: Homo sapiens similar to 40S ribosomal protein S3a (V-fos transformation effector protein) (LOC643932), mRNA [XR_017289] |
| 693 | A_32_P46765 | C12orf29 | TTTAGAATAGCCAGTGATCAGTCAGCTAGCTAATTCTCATATCATGCCTTTTGTCCTGTTAC | SEQ ID NO: 1561 | Homo sapiens chromosome 12 open reading frame 29 (C12orf29), mRNA [NM_001009894] |
| 694 | A_32_P49164 | AV714556 | AAATGCAGACTTGTTATTTGCCAAAGAAGAATTCATCATGTTCCTTCCTTCTTTTTGCC | SEQ ID NO: 1562 | AV714556 AV714556 DCB Homo sapiens cDNA clone DCBADG06 5', mRNA sequence [AV714556] |
| 695 | A_32_P49392 | A_32_P49392 | AATTCTGCCAAATCTGGAAGAAGATGGAAAATCATGACCGAAGAGGTGGAGACAAATG | SEQ ID NO: 1563 | |
| 696 | A_32_P50417 | LOC649314 | AATCAGGCTGAATTTTCTAAATGCAACTTCATCATTCTGGAAATCAGCAAGACTCACTTC | SEQ ID NO: 1564 | Homo sapiens cDNA FLJ35212 fis, clone PROST1000136. [AK092531] |
| 697 | A_32_P54305 | LOC401397 | AGAATCTTAGGAAATCACCACGTCGGTATAATCACTGCCTCCTGAATCGTTGAGGAG | SEQ ID NO: 1565 | Homo sapiens hypothetical LOC401397, mRNA (cDNA clone IMAGE:4244115), complete cds. [BC107860] |
| 698 | A_32_P58074 | RPS3A | GTTGGTTTTACTAAAAAACGCAAAAATCAGATACGGAAGACCTCTTATGCTCAGCAGGAA | SEQ ID NO: 1566 | Homo sapiens ribosomal protein S3A (RPS3A), mRNA [NM_001006] |
| 699 | A_32_P61857 | KIAA1468 | TCAGTGTACAGTTCCACTGGAATTTGACAGTTGTCTCTACAGTCATGCAACTGGAAGTAG | SEQ ID NO: 1567 | Homo sapiens KIAA1468 (KIAA1468), mRNA [NM_020854] |
| 700 | A_32_P62342 | GLT8D3 | TGTGATGTAACTGATGTAACCATTGACAATGCTATGTGTGGCTTTATACATTTCATCTCTG | SEQ ID NO: 1568 | Homo sapiens glycosyltransferase 8 domain containing 3, mRNA (cDNA clone MGC:21651 IMAGE:4508300), complete cds. [BC039145] |
| 701 | A_32_P68586 | ARL1 | TTGGGTTACCTGCCTTGAAGGACGGAAAATGGCAGAATATTCAAAACGTCAGCAACGAAAG | SEQ ID NO: 1569 | Homo sapiens ADP-ribosylation factor-like 1 (ARL1), mRNA [NM_001177] |
| 702 | A_32_P7118 | PSMC6 | AGCAGACTGAGAATGTTTGTAGTGACAGCAGGTATGTCGGCAATTGGTGCTGATCATGA | SEQ ID NO: 1570 | Homo sapiens proteasome (prosome, macropain) 26S subunit, ATPase, 6 (PSMC6), mRNA [NM_002806] |
| 703 | A_32_P77571 | AK024584 | GTCATCCTCTTAATGAAGCATTATGCAGCTGTTAAAGATGATAGATCTAAAGGTTATGAG | SEQ ID NO: 1571 | Homo sapiens cDNA: FLJ20931 fis, clone ADSE01282. [AK024584] |
| 704 | A_32_P81768 | TMEM167 | CCTCAGTAGTGTCACTACAATATTACATTCTGAAATGTTATTCTGTTGTATCAGATACG | SEQ ID NO: 1572 | Homo sapiens transmembrane protein 167 (TMEM167), mRNA [NM_174909] |
| 705 | A_32_P83784 | CENTD1 | ACAGGCCCATACTTCAGTCAGTCAGTCAATCAGTCAATCATCAGAGTACAGATGATGTGGTGGTAGAT | SEQ ID NO: 1573 | Homo sapiens centaurin, delta 1 (CENTD1), transcript variant 1, mRNA [NM_015230] |
| 706 | A_32_P86400 | LYSMD3 | AAATGTTGCTCAGGTAATCAGTATTTTCTTCGACGTATGTGCATATTGCACTGTTAGATC | SEQ ID NO: 1574 | Homo sapiens LysM, putative peptidoglycan-binding, domain containing 3 (LYSMD3), mRNA [NM_198273] |
| 707 | A_32_P86494 | A_32_P86494 | TGAGCCTTCCCTGCCACATTGAGATGATGCCTTACTGAAAAGGAAACAGATTGTTCCTAAAC | SEQ ID NO: 1575 | |
| 708 | A_32_P8857 | A_32_P8857 | TAATGTCGGAATGGTACACACTGTTTGTGTAAAGTGACATCTTTCAGATAGTTCCTGGCT | SEQ ID NO: 1576 | |

Fig. 3-39

| No. | Probe ID No. | Symbols of genes | Sequence | SEQ ID NO: | Descriptions of genes (letters and numbers within [ ] indicates GenBank accession No.) |
|---|---|---|---|---|---|
| 709 | A_32_P89679 | THC2643265 | TTATAGGTCAGAAAAATGAGGTCCACACTAATTTTGCGTCTTCCACAGGGAGATAGATTC | SEQ ID NO: 1577 | ALU1_HUMAN (P39188) Alu subfamily J sequence contamination warning entry, partial (5%) [THC2643265] |
| 710 | A_32_P93782 | RPL26 | AGGTTGTACATGGACACTATAAAAGGTCAGCAAATTGGCAAAGTAGTCCAGGTTTACAGGA | SEQ ID NO: 1578 | Homo sapiens ribosomal protein L26 (RPL26), mRNA [NM_000987] |
| 711 | A_32_P9382 | RP11-11C5.2 | AACAAAGCAGGAAAATATATTGAGAAGGGATCGTGTTTACAGAGGACTTCTTTAAAGTGT | SEQ ID NO: 1579 | Homo sapiens similar to RIKEN cDNA 2410129H14 (LOC440145), mRNA [NM_001071775] |
| 712 | A_32_P96213 | TPT1 | GAAAGGACAAGTAATCACTGGTGTCGATGTTGTCATGAACCATCACCTGGAGGAAACAAGT | SEQ ID NO: 1580 | Homo sapiens tumor protein, translationally-controlled 1 (TPT1), mRNA [NM_003295] |
| 713 | A_32_P98313 | NDUFA4 | AGCCCTGGAAACAAACTGGGTCCCAATGATCAATACAAAGTTCTGCTCAGTGAATGTGGATT | SEQ ID NO: 1581 | Homo sapiens NADH dehydrogenase (ubiquinone) 1 alpha subcomplex, 4, 9kDa (NDUFA4), nuclear gene encoding mitochondrial protein, mRNA [NM_002489] |

Fig. 4-1

| No. | Probe ID No. | Symbols of genes | Sequence | SEQ ID NO. | Description of genes (letters and numbers within [ ] indicates GenBank accession No.) |
|---|---|---|---|---|---|
| 1 | A_32_P184330 | AK130741 | TGTGACCGTTTGTGACGAGTTATCTCAGTCGTCACATGAGTTCTTACATGAGTCGGTCTA | SEQ ID NO: 923 | Homo sapiens cDNA FLJ27231 fis, clone SYN06240. [AK130741] |
| 2 | A_32_P209582 | THC2663167 | CAATGTAAAGCCAGAATATCGAAGGTCGTTTGTCAAGATTTTCAAAGCTATTTGGCTGAT | SEQ ID NO: 927 | ALU1_HUMAN (P39188) Alu subfamily J sequence contamination warning entry, partial (5%) [THC2663167] |
| 3 | A_32_P213509 | THC2663555 | GATTTGTTCCAGTGTTGGAGCCCTTTTAATGAAAATCTCAAACACCTACACTGAAAAA | SEQ ID NO: 929 | |
| 4 | A_32_P227110 | THC2512148 | TAAACAAATCGTTTTGATTCAGCCACGTGTGTATTGATAATGGCTTATTTATTACAATCA | SEQ ID NO: 932 | |
| 5 | A_32_P71171 | A_32_P71171 | TCTAGATAGTAATAGGAAACCAAGAATCCAGCGTCGGTGATGGGTGGAGGGAGTGATTGAA | SEQ ID NO: 946 | |
| 6 | A_32_P88940 | THC2745859 | AAGAGTATCCCAAGATAGCAAAGGTGTGTTGTTTTTAGCAGGTGTATTTCAGGTAGTTA | SEQ ID NO: 952 | |
| 7 | A_23_P128930 | PSMC6 | GAACAAGGAAGAATTAGAGATAGTGAAAATCCAATGCAAGGTCCCATTACAAAGCATGGTGAA | SEQ ID NO: 986 | Homo sapiens proteasome (prosome, macropain) 26S subunit, ATPase, 6 (PSMC6), mRNA [NM_002806] |
| 8 | A_23_P143358 | RPL22L1 | ATTGGCTTGGAGTGTTGGCATCTGACAAGGAGAGACCTACGAACTTCGTTAGTTCCAGATTA | SEQ ID NO: 998 | Homo sapiens ribosomal protein L22-like 1, mRNA (cDNA clone IMAGE:4865966). [BC049823] |
| 9 | A_23_P144497 | RPS3A | CCAAATCCGGAAGAAGAATGAAAATGATGGAAAATCATGACCCGAGAGGTCGAAGACAAATGACTTGAA | SEQ ID NO: 1000 | Homo sapiens ribosomal protein S3A (RPS3A), mRNA [NM_001006] |
| 10 | A_23_P14708 | SUHW4 | TCTTTGTACCTCCATACAGTGTTAGGCTGCCAGGCTGTAAGCTTACCTTAATTAAACTT | SEQ ID NO: 1006 | Homo sapiens suppressor of hairy wing homolog 4 (Drosophila) (SUHW4), transcript variant 1, mRNA [NM_017661] |
| 11 | A_23_P14734 | RPS27L | TAGAAGATACCACGACGGTTTCAGCCATGCTCAGACAGTGGTTCTTTGTGTAGGTGTTCA | SEQ ID NO: 1007 | Homo sapiens ribosomal protein S27-like (RPS27L), mRNA [NM_015920] |
| 12 | A_23_P152002 | BCL2A1 | TGTAACCATATTTGCATTTGAAGGTATTCCATCAGAAAACTTCTAGGACAGAATTGC | SEQ ID NO: 1013 | Homo sapiens BCL2-related protein A1 (BCL2A1), mRNA [NM_004049] |
| 13 | A_23_P156842 | EEF1E1 | AAGAAAAGCAATCGTTCAGGCAGTGGTTAGAATACAGGGTCACTCAAGTAGAATGGGCACT | SEQ ID NO: 1019 | Homo sapiens eukaryotic translation elongation factor 1 epsilon 1 (EEF1E1), mRNA [NM_004280] |
| 14 | A_23_P157449 | POLR2K | GGTCTCTGTTGCTTGCAAATATGTTCTTGTACAGTAGTCACCATTTAGATGTGGTTGAC | SEQ ID NO: 1020 | Homo sapiens polymerase (RNA) II (DNA directed) polypeptide K, 7.0kDa (POLR2K), mRNA [NM_005034] |
| 15 | A_23_P159650 | COX7B | CAAATACGGTAATGCTGTATTAGCTAGTGGAGCCACTTTGTATTGTTACATGAGACATA | SEQ ID NO: 1022 | Homo sapiens cytochrome c oxidase subunit VIIb (COX7B), nuclear gene encoding mitochondrial protein, mRNA [NM_001866] |
| 16 | A_23_P162596 | ACTR6 | TTAACGGCTTCACTGGAGACAGAGTTTCTTAGAAGGTAGTTTGTGTGAGTGTGACTAAACT | SEQ ID NO: 1027 | Homo sapiens ARP6 actin-related protein 6 homolog (yeast) (ACTR6), mRNA [NM_022496] |
| 17 | A_23_P18325 | PDCD10 | CCAACCGACTAATTCATCAAACGAAGTTAATACTTCAGACGTTCAAAACTGTGGCCTGAA | SEQ ID NO: 1039 | Homo sapiens programmed cell death 10 (PDCD10), transcript variant 1, mRNA [NM_007217] |
| 18 | A_23_P200955 | A_23_P200955 | AGACCATGATTGAACCTCACATTGATGTCAAGACTACCGGATGGTTATTTGTTTCATGTAC | SEQ ID NO: 1046 | |

Fig. 4-2

| No. | Probe ID No. | Symbols of genes | Sequence | SEQ ID NO: | Descriptions of genes (letters and numbers within [ ] indicates GenBank accession No.) |
|---|---|---|---|---|---|
| 19 | A_23_P15751 | NDUFA5 | TAAAAGTGGAGTCACTAAATAGTTTGGCAGTACGTTTGTAATATAAGTGTAGGTGGGTATC | SEQ ID NO: 1073 | Homo sapiens NADH dehydrogenase (ubiquinone) 1 alpha subcomplex, 5, 13kDa (NDUFA5), nuclear gene encoding mitochondrial protein, mRNA [NM_005000] |
| 20 | A_23_P52201 | EAF2 | GAGGATTCCTGATATAGATGCCAGTGATCATAATAGATTTCGAGACAACAGTGGCCTTCTGAT | SEQ ID NO: 1090 | Homo sapiens ELL associated factor 2 (EAF2), mRNA [NM_018456] |
| 21 | A_23_P26021 | COPS2 | TGCTTTTTTGATCAACTGGTTGTGTTTTGCTGCTGCATTTATCCCAAGAAAACAGGTT | SEQ ID NO: 1107 | Homo sapiens COP9 constitutive photomorphogenic homolog subunit 2 (Arabidopsis) (COPS2), mRNA [NM_004236] |
| 22 | A_23_P2705 | P2RY5 | TCTGTATTGCTGTTTCCAACTGTTGTTTGTTTTGACCCTATAGTTTACTACTTTACATCGGACA | SEQ ID NO: 1108 | Homo sapiens purinergic receptor P2Y, G-protein coupled, 5 (P2RY5), mRNA [NM_005767] |
| 23 | A_23_P307940 | CAPZA2 | CTACAAGATTGGCAAAGAAGATGCAGAATGCATAAGATGAAGATTGCATGACCGGATCATT | SEQ ID NO: 1117 | Homo sapiens capping protein (actin filament) muscle Z-line, alpha 2 (CAPZA2), mRNA [NM_006136] |
| 24 | A_23_P312246 | CCDC82 | GGCTTTATAACAGATGACTGTCAAGTGAATGAGTAGCTGTTGATATCCTGTCAGTTTAGTCAA | SEQ ID NO: 1121 | Homo sapiens coiled-coil domain containing 82 (CCDC82), mRNA [NM_024725] |
| 25 | A_23_P33045 | RPL26 | TACAAAGGTCAGCAAATTGGCAAAAGTAGTCAGGTTTACAGGAAAGAAATATGTTATCTAC | SEQ ID NO: 1132 | Homo sapiens ribosomal protein L26 (RPL26), mRNA [NM_000987] |
| 26 | A_23_P339480 | HAT1 | AACATGAACACGTGGAAGAGAGATTTTCAAGGAAGTAGTGGAAGATTACCGGCGTGTTATTG | SEQ ID NO: 1134 | Homo sapiens histone acetyltransferase 1 (HAT1), transcript variant 1, mRNA [NM_003642] |
| 27 | A_23_P38275 | TH-C2504576 | TCTCGGCAAAATGAAGTTAATCCGTTTGTGAGTTCGGACGCGAAAGCAAGAATGGATTCCTGT | SEQ ID NO: 1154 | RL26_BOVIN (P61257) 60S ribosomal protein L26, complete [TH2504576] |
| 28 | A_23_P405873 | C9orf72 | GAGAATGGAAGATCAGGATCAGAGATTATTATTCCAATGCTTACTGGAGAAGTGATTCCTGT | SEQ ID NO: 1162 | Homo sapiens chromosome 9 open reading frame 72 (C9orf72), transcript variant 2, mRNA [NM_145005] |
| 29 | A_23_P44257 | COMMD8 | AACATTTACTTCTGCGCTCTGTCATGTTGGGAAAGATTGCTCTGATAAAAATAGCTGTC | SEQ ID NO: 1179 | Homo sapiens COMM domain containing 8 (COMMD8), mRNA [NM_017845] |
| 30 | A_23_P46395 | PTBP2 | AACCAGGTGGGACCAAAGTTTATGTGCCTTTAGTCTTAATTTACCTTGCATTGTAATATT | SEQ ID NO: 1183 | Homo sapiens polypyrimidine tract binding protein 2 (PTBP2), mRNA [NM_021190] |
| 31 | A_23_P50907 | ITGAV | AAAGAGTGATTAAGTGAGGTTATTTACCGCGTAAATGGTCCATTCTGCATTGTATTTCAGG | SEQ ID NO: 1191 | Homo sapiens integrin, alpha V (vitronectin receptor, alpha polypeptide, antigen CD51) (ITGAV), mRNA [NM_002210] |
| 32 | A_23_P59921 | SUB1 | CAGATTGGCAAAATGAGGTACGTTAGTGTCGTCGGCGATTTTAAAGGCAAAGTGCTAATTGAT | SEQ ID NO: 1205 | Homo sapiens SUB1 homolog (S. cerevisiae) (SUB1), mRNA [NM_006713] |
| 33 | A_23_P61674 | CLK4 | GAAAGGCGATGCAAGTTGTGTCCATTGTGACAAGTTTGTTTAATAAAACCACATACACACTTTA | SEQ ID NO: 1207 | Homo sapiens CDC-like kinase 4 (CLK4), mRNA [NM_020666] |
| 34 | A_23_P63343 | UTS2 | AGAATGTGGAAACGATACACAGAAAAGTGAGACTCGTGATTGCTTCTGGAAATACTGTGTC | SEQ ID NO: 1211 | Homo sapiens urotensin 2 (UTS2), transcript variant 1, mRNA [NM_021995] |
| 35 | A_23_P65768 | C15orf15 | TCCTTGCATTGGCATCTAGATATCAGATTATCGGATATTACGGATGTTAGATTGCATCCACTGTT | SEQ ID NO: 1216 | Homo sapiens chromosome 15 open reading frame 15 (C15orf15), mRNA [NM_016304] |
| 36 | A_23_P86280 | ZNF267 | TGTGATGAATGTGGTAAAGCCTTCAGCTATACTATAGCTGGTCATAGCTTCACTACACGAGAAGT | SEQ ID NO: 1217 | Homo sapiens zinc finger protein 267 (ZNF267), transcript variant 498723, mRNA [NM_003414] |
| 37 | A_23_P70328 | CENPQ | CAATTGGCTTACAGTTTCTGCTCGGTCATCTGGAACTTGAAAAATCGTGAAATGCCTTCAC | SEQ ID NO: 1224 | Homo sapiens centromere protein Q (CENPQ), mRNA [NM_018132] |

Fig. 4-3

| No. | Probe ID No. | Symbols of genes | Sequence | SEQ ID NO: | Descriptions of genes (letters and numbers within [ ] indicates GenBank accession No.) |
|---|---|---|---|---|---|
| 38 | A_23_P76480 | BF213738 | AAATCGAACAGGACAATGGGTAGGATGGAGCTAGACATTTACCAAATCGTTTGGCATGAACAGG | SEQ ID NO: 1239 | BF213738 601847628F1 NIH_MGC_55 Homo sapiens cDNA clone IMAGE:4078519 5', mRNA sequence [BF213738] |
| 39 | A_23_P78092 | EVI2A | GCTGAATCAGACACTTGGAAAAGAACGAAAACAGCTCAAGGACCCAACCTAGTGATGCAA | SEQ ID NO: 1244 | Homo sapiens ecotropic viral integration site 2A (EVI2A), transcript variant 1, mRNA [NM_001003927] |
| 40 | A_23_P83278 | CHMP5 | CATTGCTCTTTTATTTTTCGATTAAGAGACTCATTGCTTGGGAAATGCTTCTTGGTAC | SEQ ID NO: 1251 | Homo sapiens chromatin modifying protein 5 (CHMP5), mRNA [NM_016410] |
| 41 | A_23_P87769 | C12orf48 | GTAAGAAATATCGTCAGTCGTCCTAATGCATATGTGACTGTTTGCATATAGTTCTGTTT | SEQ ID NO: 1254 | Homo sapiens chromosome 12 open reading frame 48 (C12orf48), mRNA [NM_017915] |
| 42 | A_23_P87579 | CD69 | TGTCGAATATGTGATGTGGCAAATCTCTATTAGGAAATATTCTGTAATCTTCAGACGTAG | SEQ ID NO: 1255 | Homo sapiens CD69 molecule (CD69), mRNA [NM_001781] |
| 43 | A_24_P11045 | THC2785765 | GCACCAGAAACGTACACCTGATTTTCATGAGAAATACGGTAGGAACACAAGTCGGAATAG | SEQ ID NO: 1283 | COX7B_HUMAN (P24311) Cytochrome c oxidase polypeptide VIIb, mitochondrial precursor partial (78%) [THC2785765] |
| 44 | A_24_P115774 | BIRC2 | GATACCATTTGGTTAAAGGAAATGGTGCGGCCAACATCTTCAAAAGTGTGTAAAAGAA | SEQ ID NO: 1285 | Homo sapiens baculoviral IAP repeat-containing 2 (BIRC2), mRNA [NM_001166] |
| 45 | A_24_P144665 | LOC401975 | TGTCGATGTCAAGACTAATGATGGCTACTTCTTTAATGTGTTCTGTGTTGGTTTTACTGA | SEQ ID NO: 1301 | PREDICTED: Homo sapiens similar to ribosomal protein S3a (LOC401975), mRNA [XR_017247] |
| 46 | A_24_P153324 | LOC390413 | GAAGCTTAACAAGGTTCAATTAACATGGTGGGGATTGTAGAACCATATATTGCAGGGTA | SEQ ID NO: 1304 | PREDICTED: Homo sapiens similar to 60S ribosomal protein L7 (LOC390413), mRNA [XR_016341] |
| 47 | A_24_P175187 | SAMD9 | CAACCAGGGATACGTAATCAAAATGTAATTTCCCCTAATAAATTATGCAATATGGGCGAG | SEQ ID NO: 1316 | Homo sapiens sterile alpha motif domain containing 9 (SAMD9), mRNA [NM_017654] |
| 48 | A_24_P175188 | SAMD9 | TGGCAATGTACTGGCAGAATTAAGACATACAACCTATGTTTTGAACAAAACAACCAGGATA | SEQ ID NO: 1317 | Homo sapiens sterile alpha motif domain containing 9 (SAMD9), mRNA [NM_017654] |
| 49 | A_24_P201702 | CLEC2B | ATTGGAATTCAAGTAAATACAACTGTTCCACTCAACATGCCACCTAACTATAATTGACA | SEQ ID NO: 1327 | Homo sapiens C-type lectin domain family 2, member B (CLEC2B), mRNA [NM_005127] |
| 50 | A_24_P203909 | RPL34 | GAGGGGTTCGTGCTGTGAAGACTTAAAGTTCTTATGAAATTGTCCAAAACAAACAACATG | SEQ ID NO: 1328 | Homo sapiens ribosomal protein L34 (RPL34), transcript variant 2, mRNA [NM_033625] |
| 51 | A_24_P212864 | LOC646161 | ACAGAAGTACAACGTGCGATCGATCGAAAGAATGATGAAGTAGGCTTGTACCAGG | SEQ ID NO: 1331 | PREDICTED: Homo sapiens similar to 60S ribosomal protein L26 (LOC646161), mRNA [XR_018048] |
| 52 | A_24_P221375 | A_24_P221375 | TACTTTGGTTACCCATGTACCTACCACCTTTCAAAAATCTACAGAGAGTCAATGTGGAGGA | SEQ ID NO: 1332 | |
| 53 | A_24_P243749 | PDK4 | ATTTGACATTTGTGTGTAATTTCATGGGCCTAGTGTTGTGGTGCTTCTGTAATGGTA | SEQ ID NO: 1345 | Homo sapiens pyruvate dehydrogenase kinase, isozyme 4 (PDK4), mRNA [NM_002612] |
| 54 | A_24_P286054 | ZFYVE16 | GTGTATGTATTCTGCCATGTAGTAAGTAATTGAACAGTCTTAAATAACCAAATGGTAGAGGG | SEQ ID NO: 1359 | Zinc finger FYVE domain-containing protein 16 (Endofin) (Endosome-associated FYVE domain protein). [Source:Uniprot/SWISSPROT;Acc:Q7Z3T8] [ENST00000380248] |
| 55 | A_24_P298604 | LOC731599 | GATGGAAATCATGACCAGAGGGTGCGGCAAATGACTTGAAAGAATTGGTCAATAAAATGAT | SEQ ID NO: 1365 | PREDICTED: Homo sapiens hypothetical protein LOC731599 (LOC731599), mRNA [XR_015536] |
| 56 | A_24_P306527 | ENST00000308869 | ACCGCATCCGTGCGTGGTTATCCAGAAAATGTAATGAGGATGAAGATTCACCGAAATAAGT | SEQ ID NO: 1366 | PREDICTED: Homo sapiens similar to ribosomal protein L31 (LOC729005), mRNA [XM_001133428] |

Fig. 4-4

| No. | Probe ID No. | Symbols of genes | Sequence | SEQ ID NO: | Descriptions of genes (letters and numbers within [ ] indicates GenBank accession No.) |
|---|---|---|---|---|---|
| 57 | A_24_P316074 | LOC730902 | TATCAATGGTGTGAGCCCAAAGGTCAAAGGTGTTGCAGGTTCTTCCCTTCGTCAAAATCTT | SEQ ID NO: 1372 | PREDICTED: Homo sapiens similar to 60S ribosomal protein L7 (LOC730902), mRNA [XR_015600] |
| 58 | A_24_P320328 | SUB1 | CAGAAAAACCTGTAAAGAACAAAAGACAGGTGAGACTTCGAGAGCCCTGTCATCTTCTA | SEQ ID NO: 1373 | Homo sapiens SUB1 homolog (S. cerevisiae) (SUB1), mRNA [NM_006713] |
| 59 | A_24_P324224 | A_24_P324224 | AAAGGTGTCTGGGCCAAGAATAAGGAATTCCTATAGGCATGTGCGGTTGTCTGCAGAAAA | SEQ ID NO: 1375 | |
| 60 | A_24_P33213 | A_24_P33213 | GACCATATATTACATGGGGTACCCAAATCTGAAGTCAGTAAATGAACTTATCTACAAGG | SEQ ID NO: 1379 | |
| 61 | A_24_P333112 | A_24_P333112 | GGTCATCAGAATCAGAGAGTATCAATGTGTGAGCCCACAGAGGACCAAAAGTATTGCAAGTT | SEQ ID NO: 1380 | |
| 62 | A_24_P33607 | LOC652558 | TAAGAAATAATTGCTTTGACAGACAACCGTTTGATTGCTCCATCTCTTGGTAAGTATATGG | SEQ ID NO: 1382 | PREDICTED: Homo sapiens similar to 60S ribosomal protein L7 (LOC652558), mRNA [XR_019336] |
| 63 | A_24_P349636 | LOC388401 | AGTTGCTTGGACAGATAACACTTTGATTGCTCGATCTCTTGGTAAATATAGGATCAACTG | SEQ ID NO: 1383 | PREDICTED: Homo sapiens similar to 60S ribosomal protein L7 (LOC388401), mRNA [XR_016679] |
| 64 | A_24_P366165 | LOC391126 | ACTTCCAAGCAAATCAAAAATGCATTCAATGCACCTTCCCAGCATTCACAGG | SEQ ID NO: 1393 | PREDICTED: Homo sapiens similar to 60S ribosomal protein L26 (Silica-induced gene 20 protein) (SIG-20) (LOC391126), mRNA [XR_019504] |
| 65 | A_24_P366546 | RPL31P10 | CGGGTGTCCAGAAAACGTAATGAGGATGAAGATTCAAATAAGCTCTATACTTTGGTTACC | SEQ ID NO: 1394 | PREDICTED: Homo sapiens similar to ribosomal protein L31 (LOC390283), mRNA [XR_018695] |
| 66 | A_24_P367191 | LOC652890 | AGTTAACGATGCTGAGGACTGTAGAGCCTATATTGCCTGTGTGGTACCCAAATCTGAAGTC | SEQ ID NO: 1396 | PREDICTED: Homo sapiens similar to 60S ribosomal protein L7 (LOC652890), mRNA [XR_019644] |
| 67 | A_24_P367199 | A_24_P367199 | TCTTATGCTCAGCACCAACAGTCTGCCAAATCAGAGAAGAAGGTGTAATCATGACCTGAGA | SEQ ID NO: 1397 | |
| 68 | A_24_P381625 | PSMC6 | ATGAAAGCAGTCAGAAAGTGGCTGATTCTAAGAAGCTGGAGTCTAAATTTACTAAAA | SEQ ID NO: 1404 | Homo sapiens proteasome (prosome, macropain) 26S subunit, ATPase, 6 (PSMC6), mRNA [NM_002806] |
| 69 | A_24_P383999 | RPS3A | TGGTTTTACTAAAAAGGAACAACAATCAGATACAGAAGAGACCTACTTATGCCCAGCACCCACGG | SEQ ID NO: 1405 | Homo sapiens ribosomal protein S3A (RPS3A), mRNA [NM_001006] |
| 70 | A_24_P384411 | A_24_P384411 | ATGGCAAAATCAATAAGACTGAAGCTTTGAACAGATAATGCTTTGACAGGCTGATCTCTTG | SEQ ID NO: 1406 | |
| 71 | A_24_P384539 | LOC730452 | CAAGAAAAGCTGGCAAGCTTCTATGTACCCACGACAACCCAAATTGGCATTTGTCATCAGGA | SEQ ID NO: 1407 | PREDICTED: Homo sapiens similar to 60S ribosomal protein L7 (LOC730452), mRNA [XM_001125895] |
| 72 | A_24_P414656 | TTC33 | TACTCAACATTTGGTATATTGTTTGACTAATGGATGTTTGTTTTTGTGTTAATTTGTGA | SEQ ID NO: 1421 | Homo sapiens tetratricopeptide repeat domain 33 (TTC33), mRNA [NM_012382] |
| 73 | A_24_P41651 | LOC641790 | AAGGAGAATGGGAACTTCCTGATGTGGGCATTGATGAGGACACAACAAAGTAGTCTGGAAA | SEQ ID NO: 1423 | PREDICTED: Homo sapiens similar to ribosomal protein L31 (LOC641790), mRNA [XR_018025] |
| 74 | A_24_P418712 | A_24_P418712 | AGGGTCAACAAAGCTGTCTCGGCCAAAGAAGAATAAGGAATATCGATACCATATCTGTGTTA | SEQ ID NO: 1426 | |
| 75 | A_24_P50437 | BC065737 | TGCAGAATGATGAAGTTGCATTTAGAAAATTCCTGATTACTGAAGATGTTCAGGGCAAA | SEQ ID NO: 1430 | Homo sapiens cDNA clone IMAGE:30404477, partial cds. [BC065737] |
| 76 | A_24_P57837 | THC2567891 | AGAAATCCGGAAGACCTCTTATGCTCAGTACCAGCCAAATCCGGAAGAAGATGATGGAAA | SEQ ID NO: 1440 | Q6NXR8_HUMAN (Q6NXR8) Ribosomal protein S3a, partial (91%) [THC2567891] |

Fig. 4-5

| No. | Probe ID No. | Symbols of genes | Sequence | SEQ ID NO: | Descriptions of genes (letters and numbers within [ ] indicates GenBank accession No.) |
|---|---|---|---|---|---|
| 77 | A_24_P587938 | A_24_P587938 | CTTCAAAGAAGCAAAAGGTGGAGATGCTGGAACAGCGAGGAGGCAGATTAACAGTCTTAT | SEQ ID NO: 1441 | |
| 78 | A_24_P606663 | LOC392030 | TGTGCGGTTGCCCAGAAACGTAATGCGGGTGAAGATTCACCAAATAAGCTCCATACTTT | SEQ ID NO: 1442 | PREDICTED: Homo sapiens hypothetical LOC392030 (LOC392030), mRNA [XR_018063] |
| 79 | A_24_P685729 | A_24_P685729 | TTGAAGGTTATGTTGATGTCAAGAGTATCAGTGATTGATTTGCTTTGTCTGTTTTGTGTGG | SEQ ID NO: 1448 | |
| 80 | A_24_P6975 | LOC342994 | GGAAGAGTCGAGGGAGGTCGTGCTGTAAGACCTAAAGTTCTTATGAAATTGTCAAAAGA | SEQ ID NO: 1450 | PREDICTED: Homo sapiens similar to ribosomal protein L34 (LOC342994), mRNA [XM_938484] |
| 81 | A_24_P75158 | PTAR1 | CCATTAGATTTGTTCTTTATGTGACCATGTACCAAGCAGCACTATAAAGTATTGTATTTCTG | SEQ ID NO: 1454 | Homo sapiens mRNA; cDNA DKFZp313P0917 (from clone DKFZp313P0917). [AL832683] |
| 82 | A_24_P755505 | A_24_P755505 | ATACAGAAGACCTCTTATGCTCAGCACCAAGAGAAAAGTAAAAATGGTGAAGAAGCCCAA | SEQ ID NO: 1455 | |
| 83 | A_24_P76358 | LOC643981 | TTACTGAAGATGTTCAGGGCAAAAGTGCCTAACTTCCGGCGCATGGATCTTATTCGTGAGA | SEQ ID NO: 1458 | PREDICTED: Homo sapiens similar to 40S ribosomal protein S3a (V-fos transformation effector protein) (LOC643981), mRNA [XR_018444] |
| 84 | A_24_P792734 | PSMC6 | AGAAGGTTAACGGAGGTTACTGAATCAAATCAAATGGATTTGATACTCTGCATAGAGATTAAA | SEQ ID NO: 1459 | Homo sapiens proteasome (prosome, macropain) 26S subunit, ATPase, 6 (PSMC6), mRNA [NM_002806] |
| 85 | A_24_P84808 | LOC729449 | GAATTGCTTTGACAGATAACGCTTTGGATCTCTTGGAAAATATGGCATCATCTGTATGG | SEQ ID NO: 1465 | PREDICTED: Homo sapiens similar to 60S ribosomal protein L7 (LOC729449), mRNA [XR_015548] |
| 86 | A_24_P850187 | A_24_P850187 | TAAATGAAGTAATCTACAAGGCGTGCTTATGGCAAAATGAATTTGACTTGCACTTTCCTAC | SEQ ID NO: 1467 | |
| 87 | A_24_P113154 | LOC730861 | ACCACCAGTCAAGAATCTGTTTAAAGTTCAGACTTAAAACAGTACCAAATAAAAGTCC | SEQ ID NO: 1491 | PREDICTED: Homo sapiens similar to 40S ribosomal protein S3a (V-fos transformation effector protein) (LOC730861), mRNA [XR_015591] |
| 88 | A_24_P11931 | LOC441073 | GTGTGATCATGCCATCGGAAAGGATGAAGTTCAGGTTGTACGTGGAACACTATAAA | SEQ ID NO: 1497 | PREDICTED: Homo sapiens similar to 60S ribosomal protein L26 (Silica-induced gene 20 protein) (SIG-20) (LOC441073), mRNA [XR_016376] |
| 89 | A_32_P125549 | RPL31P4 | TCTACAGACAGTCAATGTGGGGGTACCCCAATCTGAAGTCAGTAAATGAACATACATCAAATAAAG | SEQ ID NO: 1500 | PREDICTED: Homo sapiens ribosomal protein L31 pseudogene 4 (RPL31P4), mRNA [XR_018222] |
| 90 | A_32_P128781 | A_32_P128781 | GATATATTGCATGGGGGTACCCACGAATCGAAGTCAGTAAATGAACTAATCTAGAAGAGTG | SEQ ID NO: 1502 | |
| 91 | A_32_P135818 | RPS3A | CTTGCTTCATCTGTCTGTGTTGTGTTTTAATAAAAACGCAACAATCAGATATGGAAGAC | SEQ ID NO: 1504 | Homo sapiens ribosomal protein S3A (RPS3A), mRNA [NM_001006] |
| 92 | A_32_P145153 | RPL31 | ATCGGTGTGCAGCTGTCCAGAAAACGTAATGAGGATGAAGATTCACCAAATAAGCCATAT | SEQ ID NO: 1508 | Homo sapiens ribosomal protein L31 (RPL31), mRNA [NM_000993] |
| 93 | A_32_P153725 | KIAA1033 | TTTTGTAAAAGATGGCAAGTTTGTTACCTCACTTGAGTGGGGTTTCCTTTTCCCCCAAT | SEQ ID NO: 1513 | Homo sapiens KIAA1033 (KIAA1033), mRNA [NM_015275] |
| 94 | A_32_P155364 | RPL7 | TCAACAGGGTTATTAGAAAATGAACCAAGGTGTCTACCAGATTATTTTCTAAGCTGG | SEQ ID NO: 1514 | Homo sapiens ribosomal protein L7 (RPL7), mRNA [NM_000971] |
| 95 | A_32_P164203 | THC2683448 | TTGATGGTCATTGTACGAGGTATTGTGATTAGTGTGAGTGCTGTTTAACCAGATGAT | SEQ ID NO: 1519 | Q7WZ63_PASPI (Q7WZ63) Ferric uptake regulator, partial (8%) [THC2683448] |

Fig. 4-6

| No. | Probe ID No. | Symbols of genes | Sequence | SEQ ID NO: | Descriptions of genes (letters and numbers within [ ] indicates GenBank accession No.) |
|---|---|---|---|---|---|
| 96 | A_32_P190468 | hCG_26523 | CCCAGGAAGGTGGTTATCACTAGGCTAAAACTGGAGAAAGACCGCAAAAGATCCTTGAA | SEQ ID NO: 1531 | PREDICTED: Homo sapiens similar to 60S ribosomal protein L26 (LOC646161), mRNA [XR_018048] |
| 97 | A_32_P196483 | RPS3A | GGGGCCAAGAAGAAAGTGGTTGATCCATTTCAAGAAAGATTGGTATGATGTGAAAGCA | SEQ ID NO: 1534 | Homo sapiens ribosomal protein S3A (RPS3A), mRNA [NM_001006] |
| 98 | A_32_P208178 | RPS3A | GGAAAAGACGTTAGAAAAGGCTTGCCAATCTATTTATCCTCTCCATCATGTCTTGGTTAGA | SEQ ID NO: 1544 | Homo sapiens ribosomal protein S3A (RPS3A), mRNA [NM_001006] |
| 99 | A_32_P220127 | RPL34 | CAAAACTAGGCTGTCCTGAACCCCTGCTAATAGAATTGTTCACCTTTATACCAAGAAGGT | SEQ ID NO: 1546 | Homo sapiens ribosomal protein L34 (RPL34), transcript variant 2, mRNA [NM_033625] |
| 100 | A_32_P22539 | hCG_26523 | ACTAGGAAGGTCAGCAAATTGGCAAAGTGGTCCAGGTTTACAGGAAGAAATATGTTATCT | SEQ ID NO: 1549 | PREDICTED: Homo sapiens similar to 60S ribosomal protein L26 (Silica-induced gene 20 protein) (SIG-20) (LOC400055), mRNA [XM_374987] |
| 101 | A_32_P2333 | SUB1 | AGGAAGAAAAGTATTTCTTTAAATCCAGAACAATGGAGCCAGCTGACAGAACAGATTC | SEQ ID NO: 1551 | Homo sapiens SUB1 homolog (S. cerevisiae) (SUB1), mRNA [NM_006713] |
| 102 | A_32_P4532 | LOC643932 | GATTCAGAGACAGCATTGGAAAAGACATAGAAGAAAGGGTTGCCAATCTATCCTCTCCATGAT | SEQ ID NO: 1560 | PREDICTED: Homo sapiens similar to 40S ribosomal protein S3a (V-fos transformation effector protein) (LOC643932), mRNA [XR_017289] |
| 103 | A_32_P49392 | A_32_P49392 | AATTCTGCCAAATCTGAAGAAGATGATGGAAATCATGACCGAAGAGGTGCAGACAAATG | SEQ ID NO: 1563 | |
| 104 | A_32_P58074 | RPS3A | GTTGGTTTACTAAAAAACGCAAAAATCAGATACGGAAGACCTCTTATGCTCAGCACCAA | SEQ ID NO: 1566 | Homo sapiens ribosomal protein S3A (RPS3A), mRNA [NM_001006] |
| 105 | A_32_P7118 | PSMC6 | AGGAGACCTGAGAAATGTTTGTACTGAAGCAGGTATGTTCGGAATTCGTGCTGATCATGA | SEQ ID NO: 1570 | Homo sapiens proteasome (prosome, macropain) 26S subunit, ATPase, 6 (PSMC6), mRNA [NM_002806] |
| 106 | A_32_P77571 | AK024584 | GTCATCTCTTAATGAAGCATTATGGAGCTGTTAAAGATGATAGATGTAAAGGTTATGAG | SEQ ID NO: 1571 | Homo sapiens cDNA: FLJ20931 fis, clone ADSE01282. [AK024584] |
| 107 | A_32_P93782 | RPL26 | AGGTTGTACATGGAACACTATAAAGGTCAGCAAATTGGCAAAGTAGTCCAGGTTTACAGGA | SEQ ID NO: 1578 | Homo sapiens ribosomal protein L26 (RPL26), mRNA [NM_000987] |

Fig. 5-1

| No. | Probe ID No. | Symbols of genes | Sequence | SEQ ID NO: | Descriptors of genes (letters and numbers within [ ] indicates GenBank accession No.) |
|---|---|---|---|---|---|
| 1 | A_23_P141415 | MYCBPAP | TGTGCAGGTGACTCTCGGGCCAAGACAACCTTCTGGAAAACGGGGTTAATAAATCAA | SEQ ID NO: 1582 | Homo sapiens MYCBP associated protein (MYCBPAP), mRNA [NM_032133] |
| 2 | A_23_P143247 | TSH22 | CCCAAGAAGACGGTATGCAAATCTGTAAGTTTACGGGACTCTCAATGACCACTATCAGTCA | SEQ ID NO: 1583 | Homo sapiens teashirt family zinc finger 2 (TSHZ2), mRNA [NM_173485] |
| 3 | A_23_P146325 | DDEF1IT1 | TGGAAAGTGAAGTGAAGGATTTTTGTCATACAGACCAGTAAGTGCCAGAAGTGACTCGAAC | SEQ ID NO: 1584 | Homo sapiens DDEF1 intronic transcript 1 (DDEF1IT1) on chromosome 8 [NR_002765] |
| 4 | A_23_P151426 | FOXO1 | TGGGGTTAGTGAGCAGGTTAGAGTTAAAAGTAGTTCAGATTGTCTGACACAAGGAAGTGA | SEQ ID NO: 1585 | Homo sapiens forkhead box O1A (FOXO1A), mRNA [NM_002015] |
| 5 | A_23_P151805 | FBLN5 | GGGAACCCTGGGAGTTAGGTAGTTTGCTTTTGGGTACACAGAGAAGGCTATGTAAACAGA | SEQ ID NO: 1586 | Homo sapiens fibulin 5 (FBLN5), mRNA [NM_006329] |
| 6 | A_23_P153516 | MADCAM1 | CTTTCTGGACGGAACCAGGTACTTTTACATACATTGATTCATGTCTCACGTGTCCGTAA | SEQ ID NO: 1587 | Homo sapiens mucosal vascular addressin cell adhesion molecule 1 (MADCAM1), transcript variant 1, mRNA [NM_130760] |
| 7 | A_23_P154627 | TSHZ2 | GTAATTGGGGTTCTGTAGGTTGTGTTAAAAATTGTGTGGTCGAATGCAAGGTTATTAGGCCA | SEQ ID NO: 1588 | Teashirt homolog 2 (Zinc finger protein 218) (Ovarian cancer-related protein 10-2) (OVC10-2). Source:Uniprot/SWISSPROT;Acc:Q9NRE2] [ENST00000371497] |
| 8 | A_23_P157299 | AEBP1 | ACAGTAGAGACCTAGACGTGAACTTTGGGGACTTCTGAGATCAGCGTCCTACCAAGACC | SEQ ID NO: 1589 | Homo sapiens AE binding protein 1 (AEBP1), mRNA [NM_001129] |
| 9 | A_23_P157333 | EPHA1 | TATGGGGAGATGAGCAATCAGGAGGTTATGAAGAGCATTGAGGATGACCAGTGGCTGCCC | SEQ ID NO: 1590 | Homo sapiens EPH receptor A1 (EPHA1), mRNA [NM_005232] |
| 10 | A_23_P163492 | BAIAP3 | GACCCATTTTTGGTAATCACAGAGGAGTGAAAAGGGTGCCACTGGCACCACTGGGTG | SEQ ID NO: 1591 | Homo sapiens BAI1-associated protein 3 (BAIAP3), mRNA [NM_003933] |
| 11 | A_23_P16496 | A_23_P16496 | GGAGATCTGGGGCTGGGAAGAATGTAAAGCAACCTAAACAGTAATTTAAGAATGGAGA | SEQ ID NO: 1592 | |
| 12 | A_23_P202520 | ABLIM1 | TCACTGCACTCGTTTGTCATATACTCGCATCGTCATACTCACAACTTCGTGAATAA | SEQ ID NO: 1593 | Homo sapiens actin binding LIM protein 1 (ABLIM1), transcript variant 3, mRNA [NM_001034081] |
| 13 | A_23_P209055 | CD22 | GCCTCAGGCACCACAGAAAATGTGGACTATGTGATCCTGAAACATTGACAGTGGATGGGCTG | SEQ ID NO: 1594 | Homo sapiens CD22 molecule (CD22), mRNA [NM_001771] |
| 14 | A_23_P214821 | EDN1 | AGGCGGCTGGGACATTCAGGGGACAGAAAACTCAAAGTCCAAGACAAGATTTTCTAAGGAAT | SEQ ID NO: 1595 | Homo sapiens endothelin 1 (EDN1), mRNA [NM_001955] |
| 15 | A_23_P250212 | DKFZp761P0423 | GAAGTGAATGCAGCCTGGAGACATGGCCTCAATACCTTGTTAGGATTTGTTCACCCTTTT | SEQ ID NO: 1596 | Tyrosine-protein kinase SgK223 (EC 2.7.10.2) (Sugen kinase 223). [Source:Uniprot/SWISSPROT;Acc:Q86YV5] [ENST00000330777] |
| 16 | A_23_P255896 | ENST00000335459 | GCAAGGGGCTCTACGCAGAGTAGCTGTCGAATGCTATTGCCGGAAACTGGGAGCGGAAGA | SEQ ID NO: 1597 | Homo sapiens hypothetical protein LOC129293, mRNA (cDNA clone IMAGE:5762496), partial cds. [BC051789] |
| 17 | A_23_P315378 | ATG16L1 | CTGTGTTTCCAGTTTATACTCTCTTTGTCCAAAACTCAGTTTCAAAATATTTGGAATGGGAC | SEQ ID NO: 1598 | Homo sapiens cDNA FLJ10035 fis, clone HEMBA1000919. [AK000897] |
| 18 | A_23_P315386 | RHPN1 | CGGGCTGGCCTGAAGGAGAGGGCGACTACATTGTGTCAGTGAATGGGCAGCCATGCAGGTGGT | SEQ ID NO: 1599 | Homo sapiens rhophilin, Rho GTPase binding protein 1 (RHPN1), mRNA [NM_052924] |

Fig. 5-2

| No. | Probe ID No. | Symbols of genes | Sequence | SEQ ID NO: | Descriptions of genes (letters and numbers within [ ] indicate GenBank accession No.) |
|---|---|---|---|---|---|
| 19 | A_23_P338919 | SPEG | GCAGGGGCCACTCTGTAGTGAGGGTGGAGAAATTTGGAAACACCTATTTCTTAACTCAAAT | SEQ ID NO: 1600 | Homo sapiens cDNA FLJ30825 fis, clone FEBRA2001706, highly similar to Human APEG-1 mRNA. [AK055387] |
| 20 | A_23_P341938 | NOG | GCCABCGGCTGGGGCTGGATTCCCATCCGAGTACCCCATCATTTCCGAGTGCAAGTGCTGGT | SEQ ID NO: 1601 | Homo sapiens noggin (NOG), mRNA [NM_005450] |
| 21 | A_23_P343398 | CCR7 | AAGAGAGCAACAATTTACCGACACACAGATAAAGTTTTCCCTTGAGGAAACAACAGCTTT | SEQ ID NO: 1602 | Homo sapiens chemokine (C-C motif) receptor 7 (CCR7), mRNA [NM_001838] |
| 22 | A_23_P344531 | SYNPO | TCGTGCTGCTGTGAAGATGAAGGTGCTCTTACTCAGTTAATGATGACTGACTATATTT | SEQ ID NO: 1603 | Synaptopodin. [Source:Uniprot/SWISSPROT:Acc:Q9N3X7] [ENST00000307862] |
| 23 | A_23_P357504 | AL834280 | CCCACAGGGCAATCAACACGCTTCTGTGAATAAATAAAAGTTTATCATTCCGTACAAAC | SEQ ID NO: 1604 | |
| 24 | A_23_P359870 | C8orf16 | CTGAGGTTATAATTTCACTTAACATTGTGCAAGTTGGCATTTTGGTTTTAGTCCAATGGT | SEQ ID NO: 1605 | Homo sapiens mRNA for hypothetical protein (C8ORF16). [AJ312926] |
| 25 | A_23_P391275 | DSCR1L2 | TAAATTATGATTTAGTGTGTGCTGTTTCCAAATTGGGAACGAGGAGAGAAATATGAACGTTC | SEQ ID NO: 1606 | Homo sapiens Down syndrome critical region gene 1-like 2 (DSCR1L2), mRNA [NM_013441] |
| 26 | A_23_P3921 | FLJ11710 | CGTGATTCATGATTGAAGTACGATTACCACACTTCTCTCCCCTTAGAGAATGCATGGATTA | SEQ ID NO: 1607 | Homo sapiens cDNA FLJ11710 fis, clone HEMBA1005149. [AK021772] |
| 27 | A_23_P420873 | NR1D1 | CCCTTCTGTACAAGATGGAAGTCTGCAACTCTCTCTCCTTAGAGAGAAAAGGAAAAGCA | SEQ ID NO: 1608 | Homo sapiens nuclear receptor subfamily 1, group D, member 1 (NR1D1), mRNA [NM_021724] |
| 28 | A_23_P48585 | SALL2 | CTAGTAAAATGTCAAGAAGACAGGAGATATTAGTGTCTTTCCCTGTATCATTAAAGGT | SEQ ID NO: 1609 | Homo sapiens sal-like 2 (Drosophila) (SALL2), mRNA [NM_005407] |
| 29 | A_23_P49638 | GRAP | CCAGGCAGACAGAAGAAGTTGGGCCAGACTAGGTTTTAGAGACTGTACAAGGACGCA | SEQ ID NO: 1610 | Homo sapiens GRB2-related adaptor protein (GRAP), mRNA [NM_006613] |
| 30 | A_23_P500130 | ANKRD15 | TTTACCGTGTCAGATTTACTTAGTCTGTCCTCTATGTATTAAATGTTTGAAGTGCCTTAGAC | SEQ ID NO: 1611 | Homo sapiens ankyrin repeat domain 15 (ANKRD15), transcript variant 2, mRNA [NM_153186] |
| 31 | A_23_P7582 | TCF7 | CCCAGAAAAACCTCCAGTAGTGGAACAACAGGTTTTCACCATAGCCCTACGTTAACCCATTTT | SEQ ID NO: 1612 | Homo sapiens transcription factor 7 (T-cell specific, HMG-box) (TCF7), transcript variant 1, mRNA [NM_003202] |
| 32 | A_23_P83388 | EPPK1 | GTTTTTTGGTGTGTTTTCTGGGTCGTCTATGTGTCATATGGTTTAGTTTCTCCCGGAA | SEQ ID NO: 1613 | Homo sapiens epiplakin 1 (EPPK1), mRNA [NM_031308] |
| 33 | A_23_P84399 | CNTNAP2 | CTTGAGGCAGATCCTTAAATATCAGACAAGAAGTTGGGGGAGCAGGGCAATGGAATATATG | SEQ ID NO: 1614 | Homo sapiens contactin associated protein-like 2 (CNTNAP2), mRNA [NM_014141] |
| 34 | A_24_P128057 | MBNL1 | AGAATATTGCTGCAAGACTATCTGTGATTGGTATCTCTGTATCATGGATTGCTTCACAA | SEQ ID NO: 1615 | Homo sapiens muscleblind-like (Drosophila), mRNA (cDNA clone IMAGE:3935812), partial cds. [BC005296] |
| 35 | A_24_P252945 | BLR1 | TTTTTTTTTAATAAAAGGCACCACCTATAAAACAGGTCAATACAGTACAGGCAGCACAGAG | SEQ ID NO: 1616 | Homo sapiens Burkitt lymphoma receptor 1, GTP binding protein (chemokine (C-X-C motif) receptor 5) (BLR1), transcript variant 2, mRNA [NM_032966] |
| 36 | A_24_P280751 | DTX1 | TCCAATTTTGAGAGCAGGGAAAGGCTGGGGCTCGACTTCAGGAGGCGAAAGGAGGAGGCCT | SEQ ID NO: 1617 | Homo sapiens deltex homolog 1 (Drosophila) (DTX1), mRNA [NM_004416] |
| 37 | A_24_P288360 | LTBP3 | CTCGTCGTGGGGGAAGCCCCAAGAGATGAGGACAGTTCAGAGGAGGATTCGACGAGTGT | SEQ ID NO: 1618 | Homo sapiens latent transforming growth factor beta binding protein 3 (LTBP3), mRNA [NM_021070] |

Fig. 5-3

| No. | Probe ID No. | Symbols of genes | Sequence | SEQ ID NO: | Descriptions of genes (letters and numbers within [ ] indicates GenBank accession No.) |
|---|---|---|---|---|---|
| 38 | A_24_P312325 | C8orf15 | CTTGTTCAATGTGACTAGTTTAGTTGCCTGTCCAATATGAAGTAGAAAAGCAGATTCTG | SEQ ID NO: 1619 | Homo sapiens chromosome 8 open reading frame 15 (C8orf15), mRNA [NM_001033662] |
| 39 | A_24_P316414 | BC014346 | TAACGTTGGGGTGTTGGGAGTAGAACTTTAGCTTTGAATAATTTAAGGGCTTGGCCTGTA | SEQ ID NO: 1620 | Homo sapiens, clone IMAGE:4042988, mRNA, partial cds. [BC014346] |
| 40 | A_24_P340112 | THC2683124 |  | TCCAATTTGTTAAGTGTTGAGTCCAACTGATGTAGAAGTTGTGACTTGTAAACCATTCATCC | SEQ ID NO: 1621 |  |
| 41 | A_24_P360499 | DDEF1IT1 | TGTTCGTTTTAATGTTAGGGCAGGTCCTATACTTCAGATTTAACTTTGAAATGTAGCATAG | SEQ ID NO: 1622 | Homo sapiens DDEF1 intronic transcript 1 (DDEF1IT1) on chromosome 8 [NR_002765] |
| 42 | A_24_P360722 | DIP2C | GGCTTTAGGTTGGCAAATAGCACTGTTTTCTTAGCTGCAAGAATTCATTGCACAATGTTT | SEQ ID NO: 1623 | Homo sapiens DIP2 disco-interacting protein 2 homolog C (Drosophila) (DIP2C), mRNA [NM_014974] |
| 43 | A_24_P37020 | THC2690931 | TGCTTCTACGTCCAAGTAAAAGAGAAAAGAGGGTGAAGGTCAGCCATGTTAGCTATGAGA | SEQ ID NO: 1624 | AF235005 suppression of tumorigenicity 16 protein [Homo sapiens] (expn=-1; wgp=0; cg=0), partial (13%) [THC2690931] |
| 44 | A_24_P413126 | TMEPAI | AAGAAACTGGTTGTTGTGTATCAGTAATCATTAGTGGGAATGATGACATTCTGAAAAGCT | SEQ ID NO: 1625 | Homo sapiens transmembrane, prostate androgen induced RNA (TMEPAI), transcript variant 1, mRNA [NM_020182] |
| 45 | A_24_P417352 | ENST00000390559 | TGACCAGCTATGACAGCGTGACCATCTCCTGGACCGGCAGAATGCGCAAGCTGTGAAAA | SEQ ID NO: 1626 | Immunoglobulin heavy chain C gene segment [Source:IMGT/GENE_DB:Acc:IGHM] [ENST00000390559] |
| 46 | A_24_P460763 | AK022443 | GTGAGTAGCAGGGTAGTTAAGATGCCTAGTGGGTCTAAATGTCAAATGCTATTGGGAGAT | SEQ ID NO: 1627 | Homo sapiens cDNA FLJ12381 fis, clone MAMMA1002566. [AK022443] |
| 47 | A_24_P491923 | THC2491622 | CTTCTGTTGTTTCTCAATAAAGTAGAACAAGTCGATCTGATGGGTGTTTAGTAGGGTATGA | SEQ ID NO: 1628 |  |
| 48 | A_24_P648264 | AL512741 | AAGAATTGAGTTAGAAGTGCCTATAATGTAATGCAGAATATTTCCGAATAATGCCTAGG | SEQ ID NO: 1629 | Homo sapiens mRNA; cDNA DKFZp667N064 (from clone DKFZp667N064) [AL512741] |
| 49 | A_24_P642771 | AK024956 | ATTCTCCATATATTTTAGTTGTTCTATTGGCTAGAAAGACAAAACAAGGGAATCTGG | SEQ ID NO: 1630 | Homo sapiens cDNA: FLJ21303 fis, clone COL02107. [AK024956] |
| 50 | A_24_P662177 | THC2666469 | GGGCAGGTAGGATTTGAATGGCATGTTACATAACCATCCTCTAAAGGGACAGAATGTACA | SEQ ID NO: 1631 |  |
| 51 | A_24_P713312 | THC2639056 | TTTATATGGTCGGATGGTCCATGTTAGGAATTAAGGGGTAATTAATAGTAATGTATGTGGA | SEQ ID NO: 1632 | ALU8_HUMAN (P39195) Alu subfamily SX sequence contamination warning entry, partial (10%) [THC2639056] |
| 52 | A_24_P728115 | AK024937 | ACTGGATAGTCACTACTTTTAGTGAGTTGAAATCTGTTTGGAGAGCTATGTAAGTACCA | SEQ ID NO: 1633 | Homo sapiens cDNA: FLJ21284 fis, clone COL01911. [AK024937] |
| 53 | A_24_P792389 | THC2671169 | ATGCTAACGGTGGAGAGTAAGGCATAAGAAGTATGACTAGAATTGCCAGCTACACATTAGA | SEQ ID NO: 1634 |  |
| 54 | A_24_P7974 | SLC26A6 | GTTGCTTTATGTAGGCAAATTCTCCGTTTGGAGCTTTTAAAATAGGATTATTTGCCAGAAC | SEQ ID NO: 1635 | Homo sapiens HSPC106 mRNA, partial cds. [AF161369] |
| 55 | A_24_P79855 | ENST00000390643 | AAACGATTGGTCCCTTTTACCCAGGAAGGACTCAAGAAGGCCGAACGTGATAGGAGATGG | SEQ ID NO: 1636 | Homo sapiens hypothetical protein DKFZp566H0824, mRNA (cDNA clone MGC:129790 IMAGE:40021976), complete cds. [BC104430] |
| 56 | A_24_P810490 | BX099367 | AGGCCCAGAGTTGCAGAGCACCTTGGGCTACAGAGTGACAGCCTGTCTGTACAAAACTA | SEQ ID NO: 1637 | BX099367 Soares_fetal_liver_spleen_1NFLS_S1 Homo sapiens cDNA clone IMAGp998G05977, mRNA sequence [BX099367] |

Fig. 5-4

| No. | Probe ID No. | Symbols of genes | Sequence | SEQ ID NO: | Descriptions of genes (letters and numbers within [ ] indicates GenBank accession No.) |
|---|---|---|---|---|---|
| 57 | A_24_P914102 | A_24_P914102 | TTAGTAGACCCTAGATTTCTCTACAAATGTAAAATGTTATTTTT ACTGTTGAAAATCAG | SEQ ID NO: 1638 | |
| 58 | A_24_P915361 | AF086536 | AGTCACTCGAGAAGGTGAGAGCTCTGGAACTGAGGGCCTGGGAGC TCTGTTACGAGAGGAA | SEQ ID NO: 1639 | Homo sapiens full length insert cDNA clone ZE08A03. [AF086536] |
| 59 | A_24_P928025 | DKFZp547E087 | TGTTATGAACATAGTTCATGTTAAGTCTCCATTTAATACAACCT GAAATACCAAAGTTA | SEQ ID NO: 1640 | Homo sapiens cDNA FLJ30147 fis, clone BRACE2000266. [AK054709] |
| 60 | A_24_P927090 | AF116678 | TGTTGGTTTCTCTTTAACAGATTCAGGGCGTCATCCTTTGACTCGG AACGAGGAAGGAATT | SEQ ID NO: 1641 | Homo sapiens PRO1995 mRNA, complete cds. [AF116678] |
| 61 | A_24_P930337 | THC2503773 | AGGAAGTGGAACCGACACCCAAAATATGACTTGAAGAATGTAATT TAAAATGTTAGCATAG | SEQ ID NO: 1642 | |
| 62 | A_24_P930391 | AK022351 | AAGTGGGTTTAATTCCTTTTGATGAAAGGAAGAATTAGGCTTTGA TGCAAACAGTTGCTC | SEQ ID NO: 1643 | Homo sapiens cDNA FLJ12289 fis, clone MAMMA1001788. [AK022351] |
| 63 | A_24_P930983 | LOC650392 | GCCCCATTTCAAGTATACAGGAGGGAAAATGGTGCTTGAAATA AGCATGCCACAAAGG | SEQ ID NO: 1644 | Homo sapiens cDNA clone IMAGE:5264670. [BC036550] |
| 64 | A_24_P933548 | A_24_P933548 | CACCTCGACCTTATATCTTATGTTTATACGTGCAGAAGTATAAC CTAAGGGAAGGAATG | SEQ ID NO: 1645 | |
| 65 | A_24_P934861 | AF116678 | GGAGGTATCAAGCAGGAAATTCCAGTTTCTGGGAAATAGTGGACC AGATCGTCTCGATGG | SEQ ID NO: 1646 | |
| 66 | A_24_P935682 | AY358248 | AGTCAGTAATCAGGATTCAATCAATATGAGGTCTAAGCATGATGCT TGACAGTTATGGAAC | SEQ ID NO: 1647 | Homo sapiens clone DNA166629 MRSS6228 (UNQ6228) mRNA, complete cds. [AY358248] |
| 67 | A_24_P945096 | CACNA1I | CTTAGAGAGTCGCTCTTTAGCCCAGATAGACATAGTCTCTTTTTGTC TTTGTGCAATAATCA | SEQ ID NO: 1648 | Homo sapiens calcium channel, voltage-dependent, T type, alpha 1I subunit (CACNA1I), transcript variant 1, mRNA. [NM_021096] |
| 68 | A_32_P101002 | CA433167 | CTGTGAACTTGTCAAACATCATGCACTGGACAGGAGGACCTA CTGAGGAGACATTTC | SEQ ID NO: 1649 | UI-H-C00-ark-e-04-0-UI_s1 NCI_CGAP_Sub9 Homo sapiens cDNA clone UI-H-C00-ark-e-04-0-UI 3', mRNA sequence [CA433167] |
| 69 | A_32_P105940 | A_32_P105940 | GTGCCAAGGTAAGGCTACGACTTTTGGTTTTTATTTCAAGCAGAAC ATGAAAGGCCCTA | SEQ ID NO: 1650 | |
| 70 | A_32_P111394 | THC2643957 | GAATACAGTGTTCCTTTTCATCGCATATTTGACTGAAGCTAAGAC ACATCAATTATAAGG | SEQ ID NO: 1651 | |
| 71 | A_32_P112546 | LOC649344 | AGGGAGGTCACTATGCGAGGGTAGGACTGGCAGCAGGAGGACCCACC TGAAGGCTGAGCCTA | SEQ ID NO: 1652 | PREDICTED: Homo sapiens similar to Keratin, type II cytoskeletal 8 (Cytokeratin-8) (CK-8) (Keratin-8) (K8) (LOC649344), mRNA [XR_018597] |
| 72 | A_32_P116997 | THC2719256 | AAACATTAGGTAGGAGCTTGTAGAGGATATATTTGAGTGCATGAT GTCCTTCTTCTTGGC | SEQ ID NO: 1653 | BE147120 PM2-HT0224-221099-001-b10 HT0224 Homo sapiens cDNA, mRNA sequence [BE147120] |
| 73 | A_32_P121978 | A_32_P121978 | CAGATTAGACCACCTCATAATGAGTTCTTGATTGCACTTCAGATT GTCTGATGGGGCAC | SEQ ID NO: 1654 | |
| 74 | A_32_P125589 | THC2649341 | CGGTCTATCCTTGCTTCTTAGCCTTTGAATGAAAGTGAAGTGTGT CATCAGGCTAGATAG | SEQ ID NO: 1655 | |
| 75 | A_32_P12703 | THC2697162 | TTGAAAGGAAAGAGTATAGGGGGGAAGTGCCAGAGTAAACGAATC CTAAGTAAATAGGGT | SEQ ID NO: 1656 | |
| 76 | A_32_P131294 | BM854107 | AGTAGGGAAAAAAGGTTTGTTCCTTAATTAGAGAGTAGTCTGGGAAA TGCTAGCACTTGTGC | SEQ ID NO: 1657 | K-EST0136406 S22SNU16n1 Homo sapiens cDNA clone S22SNU16n1-145-F11 5', mRNA sequence [BM854107] |

Fig. 5-5

| No. | Probe ID No. | Symbols of genes | Sequence | SEQ ID NO: | Descriptions of genes (letters and numbers within [ ] indicates GenBank accession No.) |
|---|---|---|---|---|---|
| 77 | A_32_P132936 | THC2673888 | AAATGGAAGTATTGAGGAGATTAAAGAGTGGTTAAGTCATGGCCATGAATGAATTTACCA | SEQ ID NO: 1658 | O65549_9ALPH (O65549) Glycoprotein C, partial (4%) [THC2673888] |
| 78 | A_32_P136033 | AK090477 | AGCCTCCGTCTAGAGTCTCATGTCCTTCTGTGTCAGCTGGTTGACTTGAATATTGATGAA | SEQ ID NO: 1659 | Homo sapiens mRNA for FLJ00399 protein. [AK090477] |
| 79 | A_32_P136597 | THC2714164 | CCCAGTGTTTTGCCGCAGAGAAATAGATGGAAGATTCTTCCCATATCTCCTACTA | SEQ ID NO: 1660 | |
| 80 | A_32_P146826 | THC2852700 | ACCGTGTACAGGAGAGTTGGAAAGTTGTGAAGGTTTGAATTGTCTGGAGGATGTGGTTC | SEQ ID NO: 1661 | |
| 81 | A_32_P146844 | THC2639689 | CCTGTGGGCTGATTCCAGAGTGAGAGTTGAAGTTTTGTGTGCATCATCATGTGCCATTAA | SEQ ID NO: 1662 | |
| 82 | A_32_P147969 | AL080232 | TAATGAGCTGTTTTCGGCATGAACAGAAGGCAAGGAAGTGTCCAGAGAGACCTCTGGAGAATTCTT | SEQ ID NO: 1663 | Homo sapiens mRNA: cDNA DKFZp586A061 (from clone DKFZp586A061) [AL080232] |
| 83 | A_32_P155841 | AL079294 | CCTTCCTGTTTATATACCTGCAGTTCCATGTTCTGTTAAGGAAGAATGGCAAATGCAAA | SEQ ID NO: 1664 | Homo sapiens mRNA full length insert cDNA clone EUROIMAGE 362780. [AL079294] |
| 84 | A_32_P156062 | THC2681718 | CTGGAGGTTGTTGGCATTGGTTCAGTCTCTCAGGAGGTCACGGCTCAGTTCACTGTTC | SEQ ID NO: 1665 | |
| 85 | A_32_P164573 | THC2611661 | AGCTGTTTTCTATTAACACTCAAGTCTCGAGAGCTTGGAAATTTTCAAGTGCAAATG | SEQ ID NO: 1666 | RR12_SPINX (P42344) Chloroplast 30S ribosomal protein S12, partial (11%) [THC2611661] |
| 86 | A_32_P165407 | AK024926 | AAAGGAAGGAGGATCCCTGGACCAGGGACTTCACAGGAACCAAACATGATTCATGAAAA | SEQ ID NO: 1667 | Homo sapiens cDNA: FLJ21273 fis, clone COL01778. [AK024926] |
| 87 | A_32_P171253 | THC2674306 | GGCTCAGACCTTAAGGAACTGATGGTCTTCTTTACTTCGACAAAGTCTAAGCAGT | SEQ ID NO: 1668 | Q9F8M7_CARHY (Q9F8M7) DTDP-glucose 4,6-dehydratase (Fragment), partial (11%) [THC2674306] |
| 88 | A_32_P179526 | ZBTB20 | TTGAAGTTGGAAATCGAAGGGGAATCTAAAACGGACCAGAGTTTCTGCTGCTGGAAAGG | SEQ ID NO: 1669 | Homo sapiens zinc finger and BTB domain containing 20, mRNA (cDNA clone IMAGE:4291354), partial cds. [BC010934] |
| 89 | A_32_P179998 | DMRTC1 | ATATGCCAGAGTTTTATTCGTCTTGTGATTGCTGACATACCTGTGCACTCATGTGTATA | SEQ ID NO: 1670 | Homo sapiens DMRT-like family C1 (DMRTC1), mRNA [NM_033053] |
| 90 | A_32_P182458 | A_32_P182458 | ACCTAGCACAGTGGAGTGAAGTGAAACAGTTTAAATAGGACTGTTGCTTGAGTATATATGGAAA | SEQ ID NO: 1671 | |
| 91 | A_32_P185398 | THC2750143 | AAATATCCTGATACTTTAGCATATCTGCAATTATAAGAATTAAATATCAAAATTATACCAT | SEQ ID NO: 1672 | ALU1_HUMAN (P39188) Alu subfamily J sequence contamination warning entry, partial (11%) [THC2750143] |
| 92 | A_32_P194372 | AK129547 | AGACCACAGAAACATAGACCCATAGCTGATATTTGGACGCAAGCATAGGTTAAAACTAGGGGAGG | SEQ ID NO: 1673 | Homo sapiens cDNA FLJ26036 fis, clone PRS00145. [AK129547] |
| 93 | A_32_P196297 | THC2652466 | CCTTTCAGAAGACTGTAAGCCTTACCCAAGCATTAATTTTGCTGCATAGGCGGCTGTT | SEQ ID NO: 1674 | Q9BHM3_PARTE (Q9BHM3) Cyclophilin-RNA interacting protein, partial (4%) [THC2652466] |
| 94 | A_32_P208039 | AL049390 | TTTCATGTTTGAGCATTCAGATTGGGCTTTATTTCTCAAGGACATGTGGCAAACGTCACAA | SEQ ID NO: 1675 | Homo sapiens mRNA: cDNA DKFZp586D1318 (from clone DKFZp586D1318) [AL049390] |
| 95 | A_32_P208200 | THC2659414 | GACATTAAAATGAGTGGAGAAGAAACCTGAAAGCGCCGCAGAGAATAAGCTAAAATTTC | SEQ ID NO: 1676 | |
| 96 | A_32_P20912 | AK025669 | ACAACTACCTGTAGCTGGGGAGGAACATCTTGACATGCCCCATAAACTCCATTTTGGCAAA | SEQ ID NO: 1677 | Homo sapiens cDNA: FLJ22016 fis, clone HEP07422. [AK025669] |

Fig. 5-6

| No. | Probe ID No. | Symbols of genes | Sequence | SEQ ID NO: | Descriptions of genes (letters and numbers within [ ] indicates GenBank accession No.) |
|---|---|---|---|---|---|
| 97 | A_32_P209582 | THC2663167 | CAATGTAAAGCCAGAATATCAACGTCCTTTTGTCAAGATTTTCAAAGGTATTTGGCTGAT | SEQ ID NO: 1678 | ALU1_HUMAN (P39188) Alu subfamily J sequence contamination warning entry, partial (5%) [THC2663167] |
| 98 | A_32_P211048 | A_32_P211048 | GTTCAGAAAACACCTAGTAGTTAGGTTATTCAGTTGATTGATATTGGAATGAATGAGAAATGAGCAG | SEQ ID NO: 1679 | |
| 99 | A_32_P213509 | THC2663555 | GATTTGTTCCAGTGTTGGAGCCCTTTTAATGAAAATTCTCAACACCTACACTGGAAAA | SEQ ID NO: 1680 | |
| 100 | A_32_P214054 | THC2755661 | GGCTTATCTCCTTTGTTTTAACAGTTGGGGCTTTGGGTCCATAGCAATGATTGGAAAT | SEQ ID NO: 1681 | |
| 101 | A_32_P216122 | AK130891 | TTGTTCCTCTATATGTTTGGGAGGGATTCATGAAGAATTGAGTACACATATATAGGGTC | SEQ ID NO: 1682 | Homo sapiens cDNA FLJ27381 fis, clone UBA07680. [AK130891] |
| 102 | A_32_P225301 | THC2727302 | GCCTCAATCACATTTGTGATGGCCAACAAAATTTACCTAAGCATTTTGCTAACCTGAAGAA | SEQ ID NO: 1683 | ALU6_HUMAN (P39193) Alu subfamily SP sequence contamination warning entry, partial (9%) [THC2727302] |
| 103 | A_32_P227110 | THC2512148 | TAAAAGAAATCCTTTTGATTCAGCCACTGTGTATTGATAATGGCTTATTATTACAATCA | SEQ ID NO: 1684 | |
| 104 | A_32_P232851 | THC2645586 | GTTTGAAAAGGATATCCTTCACATTCGTTTCCAGAAAATTGAGGTCAGTGACTTATTTC | SEQ ID NO: 1685 | Q9P3E1_NEUGR (Q9P3E1) Related to rna-binding protein fus/tls, partial (5%) [THC2645586] |
| 105 | A_32_P34926 | AL833696 | GTGGCCAGAGAGTCAACTGCCAACCCTCCCAGTCGAGATCGGGGGTCTTGTGATAA | SEQ ID NO: 1686 | Homo sapiens mRNA; cDNA DKFZp667D139 (from clone DKFZ567D139). [AL833696] |
| 106 | A_32_P40673 | A_32_P40673 | CATCACACTTGATATTAGGACAGCGTACCTACTTGTTTATTAGTAAAGTGTCACAGGGTGATATGTA | SEQ ID NO: 1687 | |
| 107 | A_32_P41099 | THC2668419 | AGGGGCAGAAATATTTGGGTTCGTCCGTTCTATTAGTAAAGTGTCTTTGGACTATTGTCTC | SEQ ID NO: 1688 | |
| 108 | A_32_P42976 | THC2713078 | CTTATCCTTTCCTTTTGTTGGTGTGCAACCTGCCAACATTGTGGGCTCATTCTTTCTGGGTA | SEQ ID NO: 1689 | |
| 109 | A_32_P43878 | DB111455 | ATGTGAGAAAGGTTCTTAAGGTTTAATGACCAAGTTCCATGTGAGCTCTTACTTGGGA | SEQ ID NO: 1690 | DB111455 THYMU2 Homo sapiens cDNA clone THYMU2015028 5', mRNA sequence [DB111455] |
| 110 | A_32_P46404 | AK092468 | CTGTATGCCAAACCTCTTTTGCATAAATACTATGGATTCAGCCAAGAGAAAACACT | SEQ ID NO: 1691 | Homo sapiens cDNA FLJ35149 fis, clone PLACE6010485. [AK092468] |
| 111 | A_32_P5542 | AF131782 | GAGGCTCTTACGATCTAGGTAAGTCAAGTAAAGTCAAGTGGGAGGAAATGTCTTATAAATAAACAACAG | SEQ ID NO: 1692 | Homo sapiens clone 24941 mRNA sequence. [AF131782] |
| 112 | A_32_P55427 | THC2701763 | CACTTTTTATCCTATCTGTAAAACAACAAATCAGAGAGTAGATTCCATAGCTGG | SEQ ID NO: 1693 | Q9F8N7_CARHY (Q9F8N7) DTDP-glucose 4,6-dehydratase (Fragment), partial (11%) [THC2701763] |
| 113 | A_32_P55438 | A_32_P55438 | GTTGCCTTCGTCAAACCTGGTGAGGTTTGTAGTATCTTTAGTCTCACTACAGTGCAGCAG | SEQ ID NO: 1694 | |
| 114 | A_32_P61708 | A_32_P61708 | AGGAGGCAAGTGAATTGTTCTCTACAACCGAGACATACTACTATACCTTCAAGGAGACGAT | SEQ ID NO: 1695 | |
| 115 | A_32_P64570 | ANKRD15 | GCACCTTGTTCACTCCCACAGAAAATGGTGTCTGGTTCTCACTGAGACGTTTTAAGATTT | SEQ ID NO: 1696 | Homo sapiens ankyrin repeat domain 15 (ANKRD15), transcript variant 2, mRNA [NM_153186] |
| 116 | A_32_P65067 | THC2618074 | CCCCCAAAGTGAATTTAAACTTGAGTTATTATGCCGTTCTCATAGGAACAGGAAAACT | SEQ ID NO: 1697 | |

Fig. 5-7

| No. | Probe ID No. | Symbols of genes | Sequence | SEQ ID NO: | Descriptions of genes (letters and numbers within [ ] indicates GenBank accession No.) |
|---|---|---|---|---|---|
| 117 | A_32_P67209 | BU726029 | GTCCACTTATATTTATTCTGCACCTACCTGCACGTGACACTCTGCTATTCTTCAGAGAAG | SEQ ID NO: 1698 | UI-E-CI0-aac-g-02-0-UI.s1 UI-E-CI0 Homo sapiens cDNA clone UI-E-CI0-aac-g-02-0-UI 3', mRNA sequence [BU726029] |
| 118 | A_32_P70875 | CD236706 | GTTTGTTTGAGAAGTTCCTAATGCAGTAGGAGAACAAAGTGACAAGTTTTGTTATTTAGTG | SEQ ID NO: 1699 | FNDPXF03 FNP Homo sapiens cDNA, mRNA sequence [CD236706] |
| 119 | A_32_P71171 | A_32_P71171 | TCTAGAATAGTAATAGGAAAACAAGAATCCAGCCTGGTGATGGCTGGAGGGAGTGGATTGAA | SEQ ID NO: 1700 | |
| 120 | A_32_P79103 | BM932034 | GTGTACAGAATGAAAATAGACATTTTAGGAAGGTTGAGTCAGAGGTGGGAGTGGGGCATA | SEQ ID NO: 1701 | UI-E-EJ1-aji-k-24-0-UI.r1 UI-E-EJ1 Homo sapiens cDNA clone UI-E-EJ1-aji-k-24-0-UI 5', mRNA sequence [BM932034] |
| 121 | A_32_P88987 | AK022346 | ATGGGAAGTTACTACCCAGGCTTACCAAAAGGTCAGGTTTATATAAAGTGGCGTTCCTTT | SEQ ID NO: 1702 | Homo sapiens cDNA FLJ12284 fis, clone MAMMA1001757. [AK022346] |
| 122 | A_32_P89087 | AL134462 | TTCATGGAGGCTTCGTAGTGAAGGGAGACGGACTAAACAGTAAAGGGACAAATAGGATTACT | SEQ ID NO: 1703 | DKFZp547J085_r1 547 (synonym: hfbr1) Homo sapiens cDNA clone DKFZp547J085 5', mRNA sequence [AL134462] |
| 123 | A_32_P91328 | THC2841595 | GTTAGGCGAATAATGTCATTGAAGTCTTTAACTCTAGCGTGACTGTAAGGGCAGGGTTCA | SEQ ID NO: 1704 | |
| 124 | A_32_P97305 | THC2681839 | AATATGCACACAAAACTAAAGAAGAAGGATGTCACTTGACACACAGCTTCCTGCCCCCT | SEQ ID NO: 1705 | |
| 125 | A_32_P98940 | THC2745859 | AAGAGTATTCCCAAGATAGCAAAGGTGTGTTGTTTTTAGGCAGGTGTATTTCAGGCTAGTTA | SEQ ID NO: 1706 | |
| 126 | A_23_P102235 | SNRPG | ACAACAGAACAATATTGGAATGGTCGGTAATACCAGGAAGAATAGTATCATCATGTTAGAAGC | SEQ ID NO: 1707 | Homo sapiens small nuclear ribonucleoprotein polypeptide G (SNRPG), mRNA [NM_003096] |
| 127 | A_23_P104054 | C1orf9 | TAAATTTCTTTCCTGTCTGTCTGCACAATTAGCTATTCAGAGCAGAAGGGCCTGATTTTATAGA | SEQ ID NO: 1708 | Homo sapiens chromosome 1 open reading frame 9 (C1orf9), transcript variant 2, mRNA [NM_016227] |
| 128 | A_23_P106131 | KTN1 | ATGTTTTCACCCTTTCTAGTTTGTCAGAAACACTGAACAGAGTTTTGTCTTTTCAACTCC | SEQ ID NO: 1709 | Homo sapiens kinectin 1 (kinesin receptor) (KTN1), transcript variant 1, mRNA [NM_182926] |
| 129 | A_23_P108751 | FHL2 | TTTACAGAGTCGTGTAACCCTCCCGTTGCGTCAAGTCTAAACCAAGATTATGTGACTTGCAT | SEQ ID NO: 1710 | Homo sapiens four and a half LIM domains 2 (FHL2), transcript variant 2, mRNA [NM_201555] |
| 130 | A_23_P110362 | MAP2K1IP1 | ACTCAGACAAGTTGTGGAAGTTTCTTAATCTGACAGTGGTTTCAGTGTGTACCTTATCTT | SEQ ID NO: 1711 | Homo sapiens mitogen-activated protein kinase kinase 1 interacting protein 1 (MAP2K1IP1), mRNA [NM_021970] |
| 131 | A_23_P110611 | ZH2C2 | GTCTTGAAAAGGAGACTTTCAGTGTTGTTGGACTTCTTCAAACCAGGTTCTTGAATACTTAA | SEQ ID NO: 1712 | Homo sapiens zinc finger, H2C2 domain containing (ZH2C2), mRNA [NM_017676] |
| 132 | A_23_P110811 | COX7C | AGCCTCTGGAAGTGGATCAAAACTAGAACTCATATGCCATACTAGATATGTTTGTCAATAA | SEQ ID NO: 1713 | Homo sapiens cytochrome c oxidase subunit VIIc (COX7C), nuclear gene encoding mitochondrial protein, mRNA [NM_001867] |
| 133 | A_23_P111583 | CD36 | CTTTGGCTTAATGAGACTGGGACCATTGGTGATGAGAAGGCAAACATGCCTCAGAAGTGAA | SEQ ID NO: 1714 | Homo sapiens CD36 molecule (thrombospondin receptor) (CD36), transcript variant 2, mRNA [NM_001001547] |
| 134 | A_23_P114662 | CRYZ | AAGATGGTAGTTCAAAATAAGACTGCTCAGTTTCCAAGGGTTTTCAAGGCTACTTACCTT | SEQ ID NO: 1715 | Homo sapiens crystallin, zeta (quinone reductase) (CRYZ), mRNA [NM_001889] |

Fig. 5-8

| No. | Probe ID No. | Symbols of genes | Sequence | SEQ ID NO: | Descriptions of genes (letters and numbers within [ ] indicates GenBank accession No.) |
|---|---|---|---|---|---|
| 135 | A_23_P11652 | USP1 | TTGGGCATGGACTAATTGTATGTGTTTAACTCATATTCTGCACGATCTGTATAGTAC | SEQ ID NO: 1716 | Homo sapiens ubiquitin specific peptidase 1 (USP1), transcript variant 1, mRNA [NM_003368] |
| 136 | A_23_P11685 | PLA2G4A | GAAATGGCAAGCAGTTCTGATGCTGAGGCAGTTTGCAATCCCATGACACTGGATTTAAA | SEQ ID NO: 1717 | Homo sapiens phospholipase A2, group IVA (cytosolic, calcium-dependent) (PLA2G4A), mRNA [NM_024420] |
| 137 | A_23_P117721 | RPS17 | AATTATGTTCCTGAGGTCTCAGGCTTGGATGCAGGAGATTATTGAAGTAGAATCCTGACACT | SEQ ID NO: 1718 | Homo sapiens ribosomal protein S17 (RPS17), mRNA [NM_001021] |
| 138 | A_23_P117852 | KIAA0101 | TACTGCTGCCATTTTTATTGGTGTTTGATTATTGGAATGGTGCCATATTGTCACTCCTTC | SEQ ID NO: 1719 | Homo sapiens KIAA0101 (KIAA0101), transcript variant 1, mRNA [NM_014736] |
| 139 | A_23_P118516 | FAM18B | TATTTCTGTAGATTGTTTTCAGGAGAGAAAGTTTTGCTTGTGTATGGTAAGAGTGGAGCACTTTG | SEQ ID NO: 1720 | Homo sapiens family with sequence similarity 18, member B (FAM18B), mRNA [NM_016078] |
| 140 | A_23_P120048 | BA22B | TATTTTCGTCTGAAGGTAATGATAAGGTACACATCTGTACAGTAATTATCCTCTACCAAG | SEQ ID NO: 1721 | Homo sapiens bromodomain adjacent to zinc finger domain, 2B (BA22B), mRNA [NM_013450] |
| 141 | A_23_P120316 | MTHFD2 | AGGATTATTCCTTGGCTATTAGTACTCATTTTATGTATGTTACCCTTCAGTAAGTTCTCCG | SEQ ID NO: 1722 | Homo sapiens methylenetetrahydrofolate dehydrogenase (NADP+ dependent) 2, methenyltetrahydrofolate cyclohydrolase (MTHFD2), nuclear gene encoding mitochondrial protein, transcript variant 1, mRNA [NM_006636] |
| 142 | A_23_P1206 | RPS24 | TTTGGATTCAGAACTCATTTGGTGGTGGCAAGACAGAACTGGGCTTTGGCATGATTTATGAT | SEQ ID NO: 1723 | Homo sapiens ribosomal protein S24 (RPS24), transcript variant 2, mRNA [NM_001026] |
| 143 | A_23_P120902 | LGALS2 | CTGAGCTACGTGAGCGTAAGGGCACGGGTTCAACGATGTCCTCTTTCAAGTTAAAAGAATAA | SEQ ID NO: 1724 | Homo sapiens lectin, galactoside-binding, soluble, 2 (LGALS2), mRNA [NM_006498] |
| 144 | A_23_P121386 | IFT57 | TGGAACACACACTACTCCAATCAAAGCTGAAGGAGAAGTGCAAACATGACTAGGAACATGC | SEQ ID NO: 1725 | Homo sapiens intraflagellar transport 57 homolog (Chlamydomonas) (IFT57), mRNA [NM_018010] |
| 145 | A_23_P121622 | SULT1B1 | GAAATAGAGATTGTCTGTAGTTGATTGAAACCAAGGGCAGTTATGAATTGATTTGGGCAAT | SEQ ID NO: 1726 | Homo sapiens mRNA for ST1B2, complete cds. [D89479] |
| 146 | A_23_P121825 | FLJ13611 | GATGTGTTACTGTTACAAAACTTTCTCTGTCCATGTAATCACACTTAGTTATGAGCAAAG | SEQ ID NO: 1727 | Homo sapiens hypothetical protein FLJ13611 (FLJ13611), mRNA [NM_024841] |
| 147 | A_23_P122174 | XRCC4 | AAACCAAAGTGATCTCTCTGGGTTGGCTTCAGCTGCTGTAAGTAAAGATGATTCCATTAT | SEQ ID NO: 1728 | Homo sapiens X-ray repair complementing defective repair in Chinese hamster cells 4 (XRCC4), transcript variant 3, mRNA [NM_022550] |
| 148 | A_23_P123315 | BC067244 | CTTCCAAATCACTGGTTTGGGAGGGGGTGGATACATCCTCATTTTCTGTACAGATGCAT | SEQ ID NO: 1729 | Homo sapiens cDNA clone IMAGE:4807381, partial cds. [BC067244] |
| 149 | A_23_P123343 | NUDCD1 | TTGGCCTCTTTTGTACTTGGAAAAGTATTCAGTGCTACGCTGGAGGTCGTGGACAGTTATACTG | SEQ ID NO: 1730 | Homo sapiens NudC domain containing 1 (NUDCD1), mRNA [NM_032869] |
| 150 | A_23_P123608 | JAK2 | GGATAAGATGGCTGGATGAAAGAAAATGACCTTCATTCTGAGACCAAAGTAGATTTACAGA | SEQ ID NO: 1731 | Homo sapiens Janus kinase 2 (a protein tyrosine kinase) (JAK2), mRNA [NM_004972] |
| 151 | A_23_P127279 | FAM35A | TGCTAGATTCCAGGCATTGTACTAAGTATGTGGGAACCACAGAGAAGACATTCCCTCAGAA | SEQ ID NO: 1732 | Homo sapiens family with sequence similarity 35, member A (FAM35A), mRNA [NM_019054] |
| 152 | A_23_P127579 | PTS | GTGGTTTATAAAGGAGAATAGGCTATTGGGGTTAGCATTGCACAAAGCCCAGTTTCTTTCT | SEQ ID NO: 1733 | Homo sapiens 6-pyruvoyltetrahydropterin synthase (PTS), mRNA [NM_000317] |
| 153 | A_23_P128192 | PFDN5 | CACGTCCATTGCTCAGGTCAAAGTGGTACAGAGCCAAGTATGTGGAAGGCAAGGACTGTCT | SEQ ID NO: 1734 | Homo sapiens prefoldin subunit 5 (PFDN5), transcript variant 1, mRNA [NM_002624] |

Fig. 5-9

| No. | Probe ID No. | Symbols of genes | Sequence | SEQ ID NO: | Descriptions of genes (letters and numbers within [ ] indicates GenBank accession No.) |
|---|---|---|---|---|---|
| 154 | A_23_P128384 | VPS29 | CAGGCTAATTGGAGAATGATGTGAAAAGTAGAACGAATGGAATAGAAAG AAAGGTTAAAGCCAG | SEQ ID NO: 1735 | Homo sapiens vacuolar protein sorting 29 homolog (S. cerevisiae) (VPS29), transcript variant 2, mRNA [NM_057180] |
| 155 | A_23_P128470 | CLEC12A | CCAACCAAATTTATGTCGTGAGGCTATATAGCAAAAGAACAAGAAGCACA AATGTAAGGCTTGTC | SEQ ID NO: 1736 | Homo sapiens C-type lectin domain family 12, member A (CLEC12A), transcript variant 1, mRNA [NM_138337] |
| 156 | A_23_P128930 | PSMC6 | GAACAAGGCAAGATTAGACATACTGAAAATCGATGCAGGTCGCATT ACAAAGGCATGGTGAA | SEQ ID NO: 1737 | Homo sapiens protease (prosome, macropain) 26S subunit, ATPase, 6 (PSMC6), mRNA [NM_002806] |
| 157 | A_23_P130444 | ZNF701 | CTCCTTGCAGAATATCATAACGTTCATTTTTGAGGTAATAGTTAC AAATGCGGTGAGCAC | SEQ ID NO: 1738 | Homo sapiens zinc finger protein 701 (ZNF701), mRNA [NM_018260] |
| 158 | A_23_P132863 | ENST00000306024 | AGGCTAAATGGTATTTTCATTTTTCAAGGCTGTCCAATAAATATG ACCAACAAGATGCAG | SEQ ID NO: 1739 | U6 snRNA-associated Sm-like protein LSm3. [Source:Uniprot/SWISSPROT;Acc:P62310] [ENST00000306024] |
| 159 | A_23_P132935 | SPCS3 | GAATGTCAGTTTGACCCTGTCTTGGAACGTCGTACCAAATGCTGG AATTCTAGTCTTGT | SEQ ID NO: 1740 | Homo sapiens signal peptidase complex subunit 3 homolog (S. cerevisiae) (SPCS3), mRNA [NM_021928] |
| 160 | A_23_P133293 | MCTP1 | AGGAAGCCAGTAAGTACAGTTATGAAAAATACTAGGAAAACTATAT CCATATGCTTTGG | SEQ ID NO: 1741 | Homo sapiens cDNA: FLJ22344 fis, clone HRC06080. [AK025997] |
| 161 | A_23_P133445 | GZMA | GAATGAATATGGTTTTGTGCTGAAGGCCTCCGAAGGTGGAAAAAACT CGTGCAATGGAGAGATT | SEQ ID NO: 1742 | Homo sapiens granzyme A (granzyme 1, cytotoxic T-lymphocyte-associated serine esterase 3) (GZMA), mRNA [NM_006144] |
| 162 | A_23_P133848 | FAM8A1 | AGTTCGGCCGAATTGAGAAAATGAGTGTGTTTTAGATTCAAGTGACG GTAAAAGGATTTGTT | SEQ ID NO: 1743 | Homo sapiens family with sequence similarity 8, member A1 (FAM8A1), mRNA [NM_016255] |
| 163 | A_23_P134714 | HRSP12 | TAAATTACACCTGTGTGCAGCGTGTATTACTGAATATAGGAAAGAG ATACCCATTACATAG | SEQ ID NO: 1744 | Homo sapiens heat-responsive protein 12 (HRSP12), mRNA [NM_005836] |
| 164 | A_23_P134786 | PHF20L1 | AGTTGTATGTGCCCCAGTGCTACATACGGCAGGTATGCGTAAGTG TGTATGCTTGTTTA | SEQ ID NO: 1745 | Homo sapiens PHD finger protein 20-like 1 (PHF20L1), transcript variant 1, mRNA [NM_016018] |
| 165 | A_23_P134925 | BNIP3L | ATTTGGGACAAAAAGGCAGGCGTTCATTTTCATATGTTCCTTGATGA AAACTGGCTGAAGAT | SEQ ID NO: 1746 | Homo sapiens BCL2/adenovirus E1B 19kDa interacting protein 3-like (BNIP3L), mRNA [NM_004331] |
| 166 | A_23_P135123 | BC216229 | CTGGTCTGAACGGTCACGGGCTGTGAACAGGTGTTCCTTACTCA TAATTCATTATTCAA | SEQ ID NO: 1747 | BC216229 RST35803 Athersys RAGE Library Homo sapiens cDNA, mRNA sequence [BC216229] |
| 167 | A_23_P135494 | CLIC4 | CTCCTCAAGCCGTAAGTGTGAACAGGAATTGGAGTATTTCTTTAT AATTTCTTGAAACAGG | SEQ ID NO: 1748 | Homo sapiens chloride intracellular channel 4 (CLIC4), mRNA [NM_013943] |
| 168 | A_23_P135499 | CLIC4 | CTTCGCTTTTTGATGTAGATGCAGATATTCTATACAGTTCTGTT GTCTTTTACTAGGAC | SEQ ID NO: 1749 | Homo sapiens chloride intracellular channel 4 (CLIC4), mRNA [NM_013943] |
| 169 | A_23_P137366 | C1QB | CACGCAGAAGAACTCACTACTGGGCATTGGAGGGTGCCAACAGCAT GTTTCCGGGTTCCT | SEQ ID NO: 1750 | Homo sapiens complement component 1, q subcomponent, B chain (C1QB), mRNA [NM_000491] |
| 170 | A_23_P137434 | RNF11 | TGTAGTATCCATATGTGTTGGTTAAATTTCCTTATGAGCCCCATGAT GGAAAGACTTAAGA | SEQ ID NO: 1751 | Homo sapiens ring finger protein 11 (RNF11), mRNA [NM_014372] |
| 171 | A_23_P136308 | CD58 | AACCTGTATCCAAGCAGGGGTCATTCAAGACACAGATATGCACT TATACGCATACCATT | SEQ ID NO: 1752 | Homo sapiens CD58 molecule (CD58), mRNA [NM_001779] |
| 172 | A_23_P136541 | AKR1C3 | TTTTGAGTTCCAGTTGACTGACTGCAGAGGACATGAAAGCCATAGATGG CCTAGAGAGAAATCT | SEQ ID NO: 1753 | Homo sapiens aldo-keto reductase family 1, member C3 (3-alpha hydroxysteroid dehydrogenase, type II) (AKR1C3), mRNA [NM_003739] |

Fig. 5-10

| No. | Probe ID No. | Symbols of genes | Sequence | SEQ ID NO: | Descriptors of genes (letters and numbers within [ ] indicates GenBank accession No.) |
|---|---|---|---|---|---|
| 173 | A_23_P140301 | PSMA3 | TGAACTAGAACTCAGCTGGGTTGGTGAATTAACTAATGGAAGACATGAAATTGTTCCAAA | SEQ ID NO: 1754 | Homo sapiens proteasome (prosome, macropain) subunit, alpha type, 3 (PSMA3), transcript variant 1, mRNA [NM_002788] |
| 174 | A_23_P141549 | RPS7 | GTCAAACTAGATGGCAGCCGGGTCATAAAGGTTCATTTGGACAAAGCACAGGAACAAT | SEQ ID NO: 1755 | Homo sapiens ribosomal protein S7 (RPS7), mRNA [NM_001011] |
| 175 | A_23_P142560 | ZEB2 | CTTTTAATGTGTGTTTGTGCAAGTCGCCATCCTTGTTACAGTGTTAAGAGGGTAACATGGGT | SEQ ID NO: 1756 | Homo sapiens zinc finger E-box binding homeobox 2 (ZEB2), mRNA [NM_014795] |
| 176 | A_23_P143858 | RPL22L1 | ATTGGCTGCAGGTGGTTGCATCTGACAAGGAGGACTAGGAACTTCGTTACTTCCAGATTA | SEQ ID NO: 1757 | Homo sapiens ribosomal protein L22-like 1, mRNA (cDNA clone IMAGE:4865966), [BC049823] |
| 177 | A_23_P144145 | DCUN1D1 | TCTTTAGTGAATATCATCTGCATATCTGTGTAAGTTGAATTGTGTTTGTTACAGTCCCTG | SEQ ID NO: 1758 | Homo sapiens RP42 protein mRNA, complete cds. [AF292100] |
| 178 | A_23_P144151 | DCUN1D1 | TATGTCTGTTTTTCTTAAAAGTCATATGGGTTCGTGGCTAATGCGTTGGATTTTACAT | SEQ ID NO: 1759 | Homo sapiens RP42 protein mRNA, complete cds. [AF292100] |
| 179 | A_23_P144497 | RPS3A | CCAAATCCGAAGAAGATGATGGAAATGATGACCGAGAGGTGCAGACAAATGACTTGAA | SEQ ID NO: 1760 | Homo sapiens ribosomal protein S3A (RPS3A), mRNA [NM_001006] |
| 180 | A_23_P145114 | GCLC | AGAATGCCTGGTTTTCGTTTGGCAAATTGGCTTGTGTAAATCAGGTTGTAAAAGGCAGATA | SEQ ID NO: 1761 | Homo sapiens glutamate-cysteine ligase, catalytic subunit (GCLC), mRNA [NM_001498] |
| 181 | A_23_P145397 | CCNC | TAGTGGACCACTTGGAAATAAACCATTGGACAGATTTCAGTAATGCTGTCAGTGGAACAC | SEQ ID NO: 1762 | Homo sapiens cyclin C (CCNC), transcript variant 1, mRNA [NM_005190] |
| 182 | A_23_P14564 | GPR65 | AACAAGTTTAAATTGTGTTGCTGATCCAATTCGTGTACTGTTTTGTAACCGAAACAGGAAG | SEQ ID NO: 1763 | Homo sapiens G protein-coupled receptor 65 (GPR65), mRNA [NM_003608] |
| 183 | A_23_P145777 | NDUFA4 | ACGCTGCTTTAGAATGAAGGTGCTTCCAGAAGCCACATCGGCACAATTTTCCACTTAACCA | SEQ ID NO: 1764 | Homo sapiens NADH dehydrogenase (ubiquinone) 1 alpha subcomplex, 4, 9kDa (NDUFA4), nuclear gene encoding mitochondrial protein, mRNA [NM_002489] |
| 184 | A_23_P14708 | SUHW4 | TCTTTGTACCTCCATACAGAGTGTTAGCGCTGCCAGGCTGTAAGCTTAGCTTAATTAAAGTT | SEQ ID NO: 1765 | Homo sapiens suppressor of hairy wing homolog 4 (Drosophila) (SUHW4), transcript variant 1, mRNA [NM_017661] |
| 185 | A_23_P14734 | RPS27L | TACAAGATCACCACGGTTTTCAGGCATGGTCAGACAGTGGTTCTTTGTGTAGGTGTTCA | SEQ ID NO: 1766 | Homo sapiens ribosomal protein S27-like (RPS27L), mRNA [NM_015920] |
| 186 | A_23_P147404 | A_23_P147404 | TGGGGTGAACATGAAATTGATTACATTTGTTGGATGGTGAGCAGCGTCCCTCTCATGTG | SEQ ID NO: 1767 | |
| 187 | A_23_P148969 | LRRC40 | GCATGTATATCAATTTATATAGATAGGTAGATAGGTTTTTGGATGATTGAGGCATGCTTAT | SEQ ID NO: 1768 | Homo sapiens leucine rich repeat containing 40 (LRRC40), mRNA [NM_017768] |
| 188 | A_23_P149775 | ARHGAP12 | TGTATAATAAAACACAGGGTTTGGAAGGTTTTGTTACAGGGAGCATGGTCTGTTGAAGAT | SEQ ID NO: 1769 | Homo sapiens Rho GTPase activating protein 12 (ARHGAP12), mRNA [NM_018287] |
| 189 | A_23_P149892 | GALNACT-2 | CATGGTGGTTCAGAATAGAATGAGACATAGCATGGTTTTTGTTTTGCTTCAATTTTC | SEQ ID NO: 1770 | Homo sapiens chondroitin sulfate GalNAcT-2 (GALNACT-2), mRNA [NM_018590] |
| 190 | A_23_P151018 | LEMD3 | GCCCATGTTGTAACCTGTTGCAAGAGTGAAATGTAAAAATAGTTGTGGCATTTTAAAAGG | SEQ ID NO: 1771 | Homo sapiens LEM domain containing 3 (LEMD3), mRNA [NM_014319] |
| 191 | A_23_P151637 | RNASE2 | GTGGTAACCCAAATATGAGCGTGTCCTAGTAACAAAACTCGCAAAATTGTCACCACAGTG | SEQ ID NO: 1772 | Homo sapiens ribonuclease, RNase A family, 2 (liver, eosinophil-derived neurotoxin) (RNASE2), mRNA [NM_002934] |

Fig. 5-11

| No. | Probe ID No. | Symbols of genes | Sequence | SEQ ID NO: | Descriptions of genes (letters and numbers within [ ] indicates GenBank accession No.) |
|---|---|---|---|---|---|
| 192 | A_23_P152002 | BCL2A1 | TGTAACGATATTTGGATTTGAAGGTATTCTCATCAAGAAACTTCTAGCAGCAAATGC | SEQ ID NO: 1773 | Homo sapiens BCL2-related protein A1 (BCL2A1), mRNA [NM_004049] |
| 193 | A_23_P154330 | TXNDC9 | CTCAGTTGTTAAATTATCTGGGAAGGGTCTGAATTCTCTATTTTTGAGATTGACTTATG | SEQ ID NO: 1774 | Homo sapiens thioredoxin domain containing 9 (TXNDC9), mRNA [NM_005783] |
| 194 | A_23_P155765 | HMGB2 | TAAAAATGCAGGTTGTAGGTTTTGATGGGTACTCATACAGTTAGATTTTAGAGCTTC | SEQ ID NO: 1775 | Homo sapiens high-mobility group box 2 (HMGB2), mRNA [NM_002129] |
| 195 | A_23_P155815 | NCAPG | AAGTTAGGAAAGACGATGGAGGTGGAATCGTTTAAGATTATGTCCAGTTATTTGTTAA | SEQ ID NO: 1776 | Homo sapiens non-SMC condensin I complex, subunit G (NCAPG), mRNA [NM_022346] |
| 196 | A_23_P155355 | TMEM161B | AGGTTTGACGTGCCATATTTTGTTTTATTCTGTGATCGTAACTAGTTGGTTTTAATAGG | SEQ ID NO: 1777 | Homo sapiens transmembrane protein 161B (TMEM161B), mRNA [NM_153354] |
| 197 | A_23_P156842 | EEF1E1 | AAGAAAAAGCAATCGTTCAGCAGTCGTTAGAATACAGGGGTCACTCAAGTAGATGGGCACT | SEQ ID NO: 1778 | Homo sapiens eukaryotic translation elongation factor 1 epsilon 1 (EEF1E1), mRNA [NM_004280] |
| 198 | A_23_P157449 | POLR2K | GGTCTCTCTTGCTTCAAAATATGTTCTTGTACAGTACTCACCATTTTAGAATGTGGTTGAC | SEQ ID NO: 1779 | Homo sapiens polymerase (RNA) II (DNA directed) polypeptide K, 7.0kDa (POLR2K), mRNA [NM_005034] |
| 199 | A_23_P157452 | POLR2K | GGAATTGTGTTCACTTATACTTGGATTTGGTCTCTTCGGCATTTCTGATTGTTGTATAGCTT | SEQ ID NO: 1780 | Homo sapiens polymerase (RNA) II (DNA directed) polypeptide K, 7.0kDa (POLR2K), mRNA [NM_005034] |
| 200 | A_23_P157795 | CTNNAL1 | GGATAGTAAAAGTTGGAGAAGCTTTTGGGGTCAGATCTGTGGAACATCATGTGATGAAGCT | SEQ ID NO: 1781 | Homo sapiens catenin (cadherin-associated protein), alpha-like 1 (CTNNAL1), mRNA [NM_003798] |
| 201 | A_23_P159650 | COX7B | CAAATACGGTAATGCTGTATTAGCTAGTGAGCAGCCACTTTCTGTATTGTTACATGGACATA | SEQ ID NO: 1782 | Homo sapiens cytochrome c oxidase subunit VIIb (COX7B), nuclear gene encoding mitochondrial protein, mRNA [NM_001866] |
| 202 | A_23_P159839 | C1GALT1C1 | TCCAAATCAGATGCATGCATGATGATGTGAATTTTGGGTTAAAGGTTTTGGCTGCGGCATTGGGCATAT | SEQ ID NO: 1783 | Homo sapiens C1GALT1-specific chaperone 1 (C1GALT1C1), transcript variant 1, mRNA [NM_152692] |
| 203 | A_23_P160405 | KCTD3 | TTGTAGGACTGCAGTTGTGAATTTGGGTTAAAGGTTTGGCTGCTGTAAGAATGTGAAT | SEQ ID NO: 1784 | Homo sapiens potassium channel tetramerisation domain containing 3 (KCTD3), mRNA [NM_016121] |
| 204 | A_23_P160466 | SLC19A2 | CTTGGTATGTGGCCATATTTATAGAATGCAATGTGCAAGTTGGTAGTGTGATGGA | SEQ ID NO: 1785 | Homo sapiens solute carrier family 19 (thiamine transporter), member 2 (SLC19A2), mRNA [NM_006996] |
| 205 | A_23_P161091 | ZMYM1 | GAGGTATTTTCCTAAGTGGTATTGTACGGTGTATACTGTGTCTTCAGCTGTGTCTCTG | SEQ ID NO: 1786 | Homo sapiens zinc finger, MYM-type 1 (ZMYM1), mRNA [NM_024772] |
| 206 | A_23_P162596 | ACTR6 | TTAACGGCTTGCACTGGACAGTTTCCTTAGAAGGAGTAGTTTTGTGTGACTGTGACTAAAGT | SEQ ID NO: 1787 | Homo sapiens ARP6 actin-related protein 6 homolog (yeast) (ACTR6), mRNA [NM_022496] |
| 207 | A_23_P163113 | PRPF39 | TAGTAATAGGGGGAAAATGTCAATTAGTAGCTTACCACAGATACTGTTCCTACCCATTTA | SEQ ID NO: 1788 | Homo sapiens PRP39 pre-mRNA processing factor 39 homolog (S. cerevisiae) (PRPF39), mRNA [NM_017922] |
| 208 | A_23_P167828 | RWDD1 | GAGGATGCGTGGAAACAACGGTGGAGGGTAGATGAGTCTTTGTTCCAAGAAATGGATGCTTG | SEQ ID NO: 1789 | Homo sapiens RWD domain containing 1 (RWDD1), transcript variant 2, mRNA [NM_016104] |
| 209 | A_23_P16817 | CLK1 | ATGGAAAGGATTCTTGAGCCTCTACCAAAACATATGAGAGAAAACCAGGAAACGTAAA | SEQ ID NO: 1790 | Homo sapiens CDC-like kinase 1 (CLK1), transcript variant 1, mRNA [NM_004071] |
| 210 | A_23_P168656 | GTPBP10 | AATTTGTGGATTTCTGATACAATGTCTTCACTGGAGCCACCATCAAAGGATGCTGTTAGT | SEQ ID NO: 1791 | Homo sapiens GTP-binding protein 10 (putative) (GTPBP10), transcript variant 2, mRNA [NM_033107] |
| 211 | A_23_P168050 | MRPS28 | GAGCAACAACAGATACAACTGTACTAGAGGGCTAATGCAGGTTCTGTTGGAATTCCAGGAGA | SEQ ID NO: 1792 | Homo sapiens mitochondrial ribosomal protein S28 (MRPS28), nuclear gene encoding mitochondrial protein, mRNA [NM_014018] |

Fig. 5-12

| No. | Probe ID No. | Symbols of genes | Sequence | SEQ ID NO: | Descriptions of genes (letters and numbers within [ ] indicate GenBank accession No.) |
|---|---|---|---|---|---|
| 212 | A_23_P17021 | SCRN3 | GTCAAAGTTAGTTCTTAGTGATGATATGGTCAAGCTAATATTAGTTCTTAGTGATCAGTGG | SEQ ID NO: 1793 | Homo sapiens secernin 3 (SCRN3), mRNA [NM_024583] |
| 213 | A_23_P170233 | CSTA | AACTGGCTACTGAGTCATGATGCCTTGCTGATAAATATAACCATCAATAAAGAAGCATTCT | SEQ ID NO: 1794 | Homo sapiens cystatin A (stefin A) (CSTA), mRNA [NM_005213] |
| 214 | A_23_P18325 | PDCD10 | CCAACCGACTAATTCATCAAACGAAGTTAATAGTTCAGACCTTCAAAACTGTGGCCTGAA | SEQ ID NO: 1795 | Homo sapiens programmed cell death 10 (PDCD10), transcript variant 1, mRNA [NM_007217] |
| 215 | A_23_P18422 | MRPL3 | GAGTAGAAAACATATGGGACTATAGTGCAACCTATTTGGGTAAAGAAACCATTTGCTA | SEQ ID NO: 1796 | Homo sapiens mitochondrial ribosomal protein L3 (MRPL3), nuclear gene encoding mitochondrial protein, mRNA [NM_007208] |
| 216 | A_23_P18598 | PI4K2B | AGGCTTAAAACGAATGTCAGCAGTTGGGGTTAACTGGGTAATTTGTGGTCTAGGGCTTTT | SEQ ID NO: 1797 | Homo sapiens phosphatidylinositol 4-kinase type 2 beta (PI4K2B), mRNA [NM_018323] |
| 217 | A_23_P19291 | TUBB2A | ACTTCTCAGATCAATCAATCGGTGCATCCTTAGTGAACTTCGTTCGTTGTGTCCTCAAGCATGGTCTTTC | SEQ ID NO: 1798 | Homo sapiens tubulin, beta 2A (TUBB2A), mRNA [NM_001069] |
| 218 | A_23_P200030 | FPGT | TAAAAATTGGTAAACTAGAAGTAAGTTGTCCACAACCCTCAGTTATGATACTTATGTGCG | SEQ ID NO: 1799 | Homo sapiens fucose-1-phosphate guanylyltransferase (FPGT), mRNA [NM_003838] |
| 219 | A_23_P200298 | AGL | TAGATTTTTAACAGGTGTCATTTGACTAAACGTTTCGGTAGAATGCTTCATACTTGAGTG | SEQ ID NO: 1800 | Homo sapiens amylo-1, 6-glucosidase, 4-alpha-glucanotransferase (glycogen debranching enzyme, glycogen storage disease type III) (AGL), transcript variant 4, mRNA [NM_000028] |
| 220 | A_23_P200507 | CNIH4 | TGGTTGAAGTCAGGCTACACTACAGTGCACAGTTGAGGAGCCAGAGAGTTCTTAAATCAT | SEQ ID NO: 1801 | Homo sapiens cornichon homolog 4 (Drosophila) (CNIH4), mRNA [NM_014184] |
| 221 | A_23_P200955 | | AGACCATGATTGAACCTCACATTGATGTCAAGACTACCGATGGTTATTTGTTTCATCTAC | SEQ ID NO: 1802 | |
| 222 | A_23_P201619 | NEK7 | TGAAGGCCAAGAGGAAGTCACTGTTAAAGGACTCGTGCCATCTTACAACGTTGGATGAA | SEQ ID NO: 1803 | Serine/threonine-protein kinase Nek7 (EC 2.7.11.1) (NimA-related protein kinase 7). [Source:Uniprot/SWISSPROT:Acc:Q8TDX7] [ENST00000367385] |
| 223 | A_23_P201918 | ABCB10 | CATGGATGAGGGTAGAGCCCTTAAGAAGTAATTAAGTCAATATGTAAATCAAATGAAGTTTTC | SEQ ID NO: 1804 | Homo sapiens ATP-binding cassette, sub-family B (MDR/TAP), member 10 (ABCB10), nuclear gene encoding mitochondrial protein, mRNA [NM_012089] |
| 224 | A_23_P202587 | KIAA1598 | GTAATAATTGCAGTAGTTGTATGTATTCGTATGTATTTTGACGTGTGGTAAGGATAGGCTG | SEQ ID NO: 1805 | Homo sapiens KIAA1598 (KIAA1598), mRNA [NM_018330] |
| 225 | A_23_P203376 | MS4A6A | ACGGGCTGTAAATTACTAGATTAGGCAAAATAGTCTGAATTCCAGAAAACAA | SEQ ID NO: 1806 | Homo sapiens membrane-spanning 4-domains, subfamily A, member 6A (MS4A6A), transcript variant 1, mRNA [NM_152852] |
| 226 | A_23_P203498 | TRIM22 | GTACATAAGAATCTATCACTAAGTAATGTATCCTTCAGAATGTGTTGGTTTACCAGTGAC | SEQ ID NO: 1807 | Homo sapiens tripartite motif-containing 22 (TRIM22), mRNA [NM_006074] |
| 227 | A_23_P203645 | CREBZF | TCTGTTGGAGTATTTTGTTCCTTACGTCAATAGTTTCCTTGCATTATTGAAATTGTGGG | SEQ ID NO: 1808 | Homo sapiens CREB/ATF bZIP transcription factor (CREBZF), mRNA [NM_001039618] |
| 228 | A_23_P204187 | FLJ22028 | CTATAAGGTTGTACTGCTGGGAAAATACAATGCACAGGAGCTAGGGACCAGATCATGAATT | SEQ ID NO: 1809 | Homo sapiens hypothetical protein FLJ22028 (FLJ22028), mRNA [NM_024854] |
| 229 | A_23_P204269 | USP15 | GACCAGGATAAATGAGGTATGTTGATCATGGCTTTGCTTTATATCTTGATATTAAAGGTG | SEQ ID NO: 1810 | Homo sapiens ubiquitin specific peptidase 15 (USP15), mRNA [NM_006313] |

Fig. 5-13

| No | Probe ID No. | Symbols of genes | Sequence | SEQ ID NO: | Descriptions of genes (letters and numbers within [ ] indicates GenBank accession No.) |
|---|---|---|---|---|---|
| 230 | A_23_P205027 | ABHD13 | ATTTGTGTGAGAATGATAAAGAATGTTCCTTTTAGAAGTGTGTTATGTCTGTAGCTGTCTG | SEQ ID NO:1811 | Homo sapiens abhydrolase domain containing 13 (ABHD13), mRNA [NM_032859] |
| 231 | A_23_P205336 | C14orf129 | CAATTCATTGCCAGACTTCATTGGAATGCTTGTTGTTGATGATGTATGTTCATTCAGCT | SEQ ID NO:1812 | Homo sapiens chromosome 14 open reading frame 129 (C14orf129), mRNA [NM_016472] |
| 232 | A_23_P205646 | MAP4K5 | CTAATGTAGGAGGGGGAAGTATTAATTGCCATGCATGATATGTATTTTACTTATACTATGCC | SEQ ID NO:1813 | Homo sapiens mitogen-activated protein kinase kinase kinase kinase 5 (MAP4K5), transcript variant 2, mRNA [NM_198794] |
| 233 | A_23_P20606 | NIPSNAP3A | GTAAGTACCGACTTCAAAAAATAGTTCTGTTTACTTTGTGATGGTATTTGAGTGTGTGTC | SEQ ID NO:1814 | Homo sapiens nipsnap homolog 3A (C. elegans) (NIPSNAP3A), mRNA [NM_015469] |
| 234 | A_23_P206228 | VPS13C | GGGATCATTATGAGTAATTTCATAGGCAACTGTCTAGTGTTTGTGTTTTAAAACAGAA | SEQ ID NO:1815 | Homo sapiens vacuolar protein sorting 13 homolog C (S. cerevisiae) (VPS13C), transcript variant 1A, mRNA [NM_017684] |
| 235 | A_23_P207299 | LOC51136 | CCAAAACAGAATTTGAAATTAGAACTAGTGGTTTTAGAGAACTGAGGTATTCTTTCCTG | SEQ ID NO:1816 | Homo sapiens PTD016 protein (LOC51136), mRNA [NM_016125] |
| 236 | A_23_P209032 | ZNF302 | TGAGAAAATGTATACTGGGGAAAAGTTGTATGAAGGTGGTGAACATGGGAGACTTTTAG | SEQ ID NO:1817 | Homo sapiens zinc finger protein 302 (ZNF302), transcript variant 1, mRNA [NM_018443] |
| 237 | A_23_P209232 | CLIP4 | GCTTATGAAATGTCATTTAAAGTTCACTCTTGAGCATCAATAAAAAGGGAAGCTGTGTG | SEQ ID NO:1818 | Homo sapiens CAP-GLY domain containing linker protein family, member 4 (CLIP4), mRNA [NM_024692] |
| 238 | A_23_P209625 | CYP1B1 | CTGTGTTTATGAAGAAGAAGTAAGGTGGTTGGAGTTTACGTGGCTTATTTAATATGCT | SEQ ID NO:1819 | Homo sapiens cytochrome P450, family 1, subfamily B, polypeptide 1 (CYP1B1), mRNA [NM_000104] |
| 239 | A_23_P210001 | PAX8 | CAAGCTTGCTTGTTTCTTAACCCCCAGAGTTTGGCCTCTGAGTGAAATGTCTCTTTGCC | SEQ ID NO:1820 | Homo sapiens paired box gene 8 (PAX8), transcript variant PAX8A, mRNA [NM_003466] |
| 240 | A_23_P210274 | PREI3 | GGATCAGTATGCCGATAGGATTTACAGAATATTTCAGACATGCTATTTCATGATCGGCAG | SEQ ID NO:1821 | Homo sapiens preimplantation protein 3 (PREI3), transcript variant 1, mRNA [NM_015387] |
| 241 | A_23_P210829 | PCMTD2 | TCCTGCGACACCTTACCAGAATTCAGTATAATACACTACTTCTGTTTTCAAACAGATA | SEQ ID NO:1822 | Homo sapiens protein-L-isoaspartate (D-aspartate) O-methyltransferase domain containing 2 (PCMTD2), mRNA [NM_018257] |
| 242 | A_23_P211840 | UBE1C | GGCAGCCTAGAGGGAAAAAATAGAACACTTACTTACGATCGGTAACCTCTATTGAAGAA | SEQ ID NO:1823 | Homo sapiens ubiquitin-activating enzyme E1C (UBA3 homolog, yeast) (UBE1C), transcript variant 1, mRNA [NM_003968] |
| 243 | A_23_P212383 | SACM1L | GCCTCTGAGGGTCTGTTCTAGATTTCATATTGCAGTTGGAGGGTAACAGCTGGTTT | SEQ ID NO:1824 | Homo sapiens SAC1 suppressor of actin mutations 1-like (yeast) (SACM1L), mRNA [NM_014016] |
| 244 | A_23_P2129 | TMEM126B | CATATGCATGATTGGCTACAGTCGATTTGTCTACTGTTGTTACTGAACGTTTTTG | SEQ ID NO:1825 | Homo sapiens transmembrane protein 126B (TMEM126B), mRNA [NM_018480] |
| 245 | A_23_P213638 | PANK3 | TGTATATAGGCAGTGTTAAATCCTTAAATGCAATACGAGGCTCTGATTATTGAGCTTCCTC | SEQ ID NO:1826 | Homo sapiens pantothenate kinase 3 (PANK3), mRNA [NM_024594] |
| 246 | A_23_P213691 | HISPPD1 | GTATGTAAGTTTCTGTTTGTTGAAAATGTAGTTAATGTACTCACTGTGGAGGTCATAAGG | SEQ ID NO:1827 | Homo sapiens histidine acid phosphatase domain containing 1 (HISPPD1), mRNA [NM_015216] |
| 247 | A_23_P213718 | UQCRQ | TTCCGTGTCTGTGAAAAGAACCGTTTCTCTGGAAAGAAGGAGTGTGCATTGTAGTGTCTCAAAGA | SEQ ID NO:1828 | Homo sapiens ubiquinol-cytochrome c reductase, complex III subunit VII, 9.5kDa (UQCRQ), nuclear gene encoding mitochondrial protein, mRNA [NM_014402] |

Fig. 5-14

| No. | Probe ID No. | Symbols of genes | Sequence | SEQ ID NO: | Descriptions of genes (letters and numbers within [ ] indicates GenBank accession No.) |
|---|---|---|---|---|---|
| 248 | A_23_P214108 | TPMT | GGTTGATGCTTTTGAAGAACGACATAAAAGTTGGGGAATTGACTGTCTTTTTGAAAAGTT | SEQ ID NO: 1829 | Homo sapiens thiopurine S-methyltransferase (TPMT), mRNA [NM_000367] |
| 249 | A_23_P215051 | ECHDC1 | TTTTTCAGAGGTAAACTCTAGATTAC:GTGTCAACCAATACTATTTGGCGCATAGATGT | SEQ ID NO: 1830 | Homo sapiens enoyl Coenzyme A hydratase domain containing 1 (ECHDC1), mRNA [NM_018479] |
| 250 | A_23_P215751 | NDUFA5 | TAAAAGTGGAGTCACTAAATAGTTGGAGTACGTTTCTAATATAAGTGTAGGTGGGTATG | SEQ ID NO: 1831 | Homo sapiens NADH dehydrogenase (ubiquinone) 1 alpha subcomplex, 5, 13kDa (NDUFA5), nuclear gene encoding mitochondrial protein, mRNA [NM_005000] |
| 251 | A_23_P216708 | RFK | ACTCAGAAAAACATCTAAAGGTGTTGGAGAAGAGGAGCTCATATAAATAGTTGGATTGCG | SEQ ID NO: 1832 | Homo sapiens riboflavin kinase (RFK), mRNA [NM_018391] |
| 252 | A_23_P21734 | TAF9 | CATGGTTGTGATTTCTTCCCTGAACGCGTGGTTTCATATAGTTTTTGTGCTGAGAACAGAT | SEQ ID NO: 1833 | Homo sapiens TAF9 RNA polymerase II, TATA box binding protein (TBP)-associated factor, 32kDa (TAF9), transcript variant 3, mRNA [NM_001015891] |
| 253 | A_23_P217384 | AP1S2 | AAACGTGTTGGTGTCTCTCACAGTATTATGTGTAAAGTCATTGTTTAAAGCACGAATGTTG | SEQ ID NO: 1834 | Homo sapiens adaptor-related protein complex 1, sigma 2 subunit (AP1S2), mRNA [NM_003916] |
| 254 | A_23_P217564 | ACSL4 | GTTATAGGTCGTTTAGAAAACACATAATTAACACTTAAGGTTGGGTGCTGCTAATTGTTTG | SEQ ID NO: 1835 | Homo sapiens acyl-CoA synthetase long-chain family member 4 (ACSL4), transcript variant 1, mRNA [NM_004458] |
| 255 | A_23_P217797 | DDX3Y | CACTGATAGGAAGGTCGACATCCACAAAGTTTCTCTTGAGTTTGTTATGTGTTTTGCTG | SEQ ID NO: 1836 | Homo sapiens DEAD (Asp-Glu-Ala-Asp) box polypeptide 3, Y-linked (DDX3Y), mRNA [NM_004660] |
| 256 | A_23_P218928 | C4orf18 | CAGATGAGTTGCATTTGGTCTGCTGTGTAGATGTGTTTTCAGAGGCTAGGTACAGAGGAATGTTTG | SEQ ID NO: 1837 | Homo sapiens chromosome 4 open reading frame 18 (C4orf18), transcript variant 2, mRNA [NM_016613] |
| 257 | A_23_P219072 | SAMD9 | AACCTACGTCGAGATAGTAAAGGCCAGTTGAAAAACTAAAAGATCAGCTTCGAGAAGTC | SEQ ID NO: 1838 | Homo sapiens sterile alpha motif domain containing 9 (SAMD9), mRNA [NM_017654] |
| 258 | A_23_P219161 | OLFM1 | GGGCTAACTTAAAAGAGTTTTTTCAATGCTGCAGTGACTGAAGAAGCAGTCACTCCCAT | SEQ ID NO: 1839 | Homo sapiens olfactomedin 1 (OLFM1), transcript variant 2, mRNA [NM_006334] |
| 259 | A_23_P2433 | RP2 | TTATTTCGTTGCATTAATAGTAGTAGTGGTGTTTTTGGTGTTTATATTTATGTCTA | SEQ ID NO: 1840 | Homo sapiens retinitis pigmentosa 2 (X-linked recessive) (RP2), mRNA [NM_006915] |
| 260 | A_23_P2262 | SURB7 | ATGTGGCTGAGAAAAGAACTGTTTGAGTGCCATTAAGAATTCTGCATCAGAGTTAGATAC | SEQ ID NO: 1841 | Homo sapiens SRB7 suppressor of RNA polymerase B homolog (yeast) (SURB7), mRNA [NM_004264] |
| 261 | A_23_P22871 | SYBL1 | CAAACGGAATACGGTCAGGAGTCAACTCCAGGGGTTGGGCTTGATTCCGTTGAATAATA | SEQ ID NO: 1842 | Homo sapiens synaptobrevin-like 1 (SYBL1), mRNA [NM_005638] |
| 262 | A_23_P2366 | NUDT4 | CATCAGTCTGTGTTGGTTTATTTGTCATCAGATTACTTGTGGGTATACCTACCCCAAATTG | SEQ ID NO: 1843 | Homo sapiens nudix (nucleoside diphosphate linked moiety X)-type motif 4 (NUDT4), transcript variant 2, mRNA [NM_199040] |
| 263 | A_23_P23765 | ITGB3BP | AGTATACAGGCTTTGGAGGGGAGTAGAGAGCTTGAAAATCTCATTGGAATCTCCTGTGGA | SEQ ID NO: 1844 | Homo sapiens integrin beta 3 binding protein (beta3-endonexin) (ITGB3BP), mRNA [NM_014288] |
| 264 | A_23_P23860 | BLOC1S2 | GAGTAAACTGGAGGACTGTGGCTATTCCTGAACCTCTTTTGAGACAGAATGCGTCAGAAT | SEQ ID NO: 1845 | Homo sapiens biogenesis of lysosome-related organelles complex-1, subunit 2 (BLOC1S2), transcript variant 2, mRNA [NM_001001342] |
| 265 | A_23_P24365 | ANKRD49 | GGGCACTGCTTGTTATAGTCTCTCGAAGTTCACAGGAAATGTTGATTTTCTAAGGTCCTCAT | SEQ ID NO: 1846 | Homo sapiens ankyrin repeat domain 49 (ANKRD49), mRNA [NM_017704] |

Fig. 5-15

| No. | Probe ID No. | Symbols of genes | Sequence | SEQ ID NO: | Descriptions of genes (letters and numbers within [ ] indicates GenBank accession No.) |
|---|---|---|---|---|---|
| 266 | A_23_P250002 | HACE1 | TAAGCAGTCATTGTGTTTCCAAGTAATAATGTTTGAGAGACAGTGTAAGTTGAAAGTTTTGGTA | SEQ ID NO: 1847 | Homo sapiens HECT domain and ankyrin repeat containing, E3 ubiquitin protein ligase 1 (HACE1), mRNA [NM_020771] |
| 267 | A_23_P250800 | ST3GAL6 | ATGTCACGAAGTTGCACCTAGCTGTTGGTTTTAAATACAAGTTTTCTGAGGTCAABAGTCCTTT | SEQ ID NO: 1848 | Homo sapiens ST3 beta-galactoside alpha-2,3-sialyltransferase 6 (ST3GAL6), mRNA [NM_061001] |
| 268 | A_23_P250930 | CRBN | TGATGTATTGAGAATTCAGGTCCTTAAAATTGGCAGTGCTATCCAGCGACTTCGCTGTGA | SEQ ID NO: 1849 | Homo sapiens cereblon (CRBN), mRNA [NM_016302] |
| 269 | A_23_P250994 | ANAPC10 | GATTCATGTTCCCTTAACTGACAATCATAAGAAGCCAACTCGTACATTCATGATACAGAT | SEQ ID NO: 1850 | Homo sapiens anaphase promoting complex subunit 10 (ANAPC10), mRNA [NM_014885] |
| 270 | A_23_P251937 | CPEB4 | GTATGTCAGTTAATTGTACTACTTGGGTGAATTTCCATATAGTTTTTACTGTGTATGGGG | SEQ ID NO: 1851 | Homo sapiens cytoplasmic polyadenylation element binding protein 4 (CPEB4), mRNA [NM_030627] |
| 271 | A_23_P252145 | C1GALT1 | ATATGTCTATATATATGAGGAACTTGTGTTTTTTAAATGGTGGCCAGGTAGAGGAAGTAG | SEQ ID NO: 1852 | Homo sapiens core 1 synthase, glycoprotein-N-acetylgalactosamine 3-beta-galactosyltransferase, 1 (C1GALT1), mRNA [NM_020156] |
| 272 | A_23_P252201 | EAF2 | CAGGATTCCTGATATAGATGCCAGTCATAATAGATTCGAGACAACAGTGGCCTTCTGAT | SEQ ID NO: 1853 | Homo sapiens ELL associated factor 2 (EAF2), mRNA [NM_018456] |
| 273 | A_23_P252235 | CLEC4D | CATTTAACCACGGCAGGAGTATTCTGGCATAAGAATGAAGCCGGACAACTCTCAGGGAGAAA | SEQ ID NO: 1854 | Homo sapiens C-type lectin domain family 4, member D (CLEC4D), mRNA [NM_080387] |
| 274 | A_23_P252371 | RBBP8 | GGGAAGGAGCAGAGAGACATAGACGTTGAAACAGAAAGAAAGAATGAAGGACAGTTTT | SEQ ID NO: 1855 | Homo sapiens retinoblastoma binding protein 8 (RBBP8), transcript variant 1, mRNA [NM_002894] |
| 275 | A_23_P252403 | COMMD10 | CCGTGCATGGATACAAGATAAGAGATGTACCTTAGTAGAATACAGAGCTTTGGTAATTAC | SEQ ID NO: 1856 | Homo sapiens COMM domain containing 10 (COMMD10), mRNA [NM_016144] |
| 276 | A_23_P252412 | MRPL50 | GAAAAGTTTTGAGAGGGGCACTGTCAACTGGGTTTAAGACAGGAGGACATTGCAAGTTCA | SEQ ID NO: 1857 | Homo sapiens mitochondrial ribosomal protein L50 (MRPL50), nuclear gene encoding mitochondrial protein, mRNA [NM_019051] |
| 277 | A_23_P254472 | C6orf211 | TTCATTTCAAATAGCTTGTTTCATTTGGACGGCCTTTGTATTTGATTGACCTGTAGAACC | SEQ ID NO: 1858 | Homo sapiens chromosome 6 open reading frame 211 (C6orf211), mRNA [NM_024573] |
| 278 | A_23_P254702 | DEK | TTTTTTATTAACTGCTTTTGCCCATATAACATGCTGATATTTAGTGGAAAGGTAGGCAGC | SEQ ID NO: 1859 | Homo sapiens DEK oncogene (DNA binding) (DEK), mRNA [NM_003472] |
| 279 | A_23_P254503 | FNDC3A | ATACTTGCCATTTGAGCCTCACTGACGAAAATTAGTGCAGAGGAGAAAACAATTTTAATGT | SEQ ID NO: 1860 | Homo sapiens fibronectin type III domain containing 3A (FNDC3A), transcript variant 2, mRNA [NM_014923] |
| 280 | A_23_P255663 | MANEA | AAAGAGTCTGTACATGTTCAGAGTTTCAGTGGGCAATTTCTTGGCCATGGATGTAGAACC | SEQ ID NO: 1861 | Homo sapiens mannosidase, endo-alpha (MANEA), mRNA [NM_024641] |
| 281 | A_23_P255827 | FKSG2 | ACTACGGTAAGGATGGTCAGTATGACCCCATATATGATTTTTTAAGGAATGGTTTAGAAA | SEQ ID NO: 1862 | Homo sapiens apoptosis inhibitor (FKSG2), mRNA [NM_021631] |
| 282 | A_23_P25638 | C13orf7 | CTTGCATCCAGGGGAGTTTCTTTGTTGAGTAGTATGTTTCTTGTTTGCATGTCCTGTGTC | SEQ ID NO: 1863 | Homo sapiens chromosome 13 open reading frame 7 (C13orf7), mRNA [NM_024546] |
| 283 | A_23_P25735 | PSMA6 | TAGGAGAGAGAGACTAAACATTGTCGTTAGTTTACCAGAATGGATCCGTGATGCCACTACGTGT | SEQ ID NO: 1864 | Homo sapiens proteasome (prosome, macropain) subunit, alpha type, 6 (PSMA6), mRNA [NM_002791] |
| 284 | A_23_P257911 | USP16 | GTACTTTGTTTTAATATATCTGGGTGATGATGACAACAACATCAATAAAGTGACTTACC | SEQ ID NO: 1865 | Homo sapiens ubiquitin specific peptidase 16 (USP16), transcript variant 1, mRNA [NM_006447] |

Fig. 5-16

| No. | Probe ID No. | Symbols of genes | Sequence | SEQ ID NO: | Descriptions of genes (letters and numbers within [ ] indicates GenBank accession No.) |
|---|---|---|---|---|---|
| 285 | A_23_P258108 | LOC731224 | GTGAGCCCAGGTGTTGGTTGCTTGTTCAATATCCCAAGCCCAGAAAGATGAGTTCATCCTTAAA | SEQ ID NO: 1866 | PREDICTED: Homo sapiens similar to 60S ribosomal protein L9 (LOC731224), mRNA [XR_015767] |
| 286 | A_23_P258582 | GK5 | ATGTCGATTTTTGGACACAGATATGATAGAACTAGAAATTAAGTTGCATTCTGCAAGTGC | SEQ ID NO: 1867 | Homo sapiens glycerol kinase 5 (putative) (GK5), mRNA [NM_001039547] |
| 287 | A_23_P259054 | SNX14 | CATGAGACTTCTCTTTGATGGGTTACAGAGCAACGAGTAGTCAAGAAGCAGCTGAGTTATGT | SEQ ID NO: 1868 | Homo sapiens sorting nexin 14 (SNX14), transcript variant 1, mRNA [NM_153816] |
| 288 | A_23_P26021 | COPS2 | TGCTTTTTCATCAACTGGTTGTGTTTTGCTGCTGCATTTATCCGAAGAAAAACAAGGTT | SEQ ID NO: 1869 | Homo sapiens COP9 constitutive photomorphogenic homolog subunit 2 (Arabidopsis) (COPS2), mRNA [NM_004236] |
| 289 | A_23_P26713 | RPL23 | TGGCCCGGAATTGCATGCAATGCTGGCAGGCATTGCATGATTCTCGAGTATATTTGTAAA | SEQ ID NO: 1870 | Homo sapiens ribosomal protein L23 (RPL23), mRNA [NM_000978] |
| 290 | A_23_P2705 | P2RY5 | TCTGTATTGCTGTTTCAACTGTTGTTTTGACCCTATAGTTTACTAGTTTACATGGGACA | SEQ ID NO: 1871 | Homo sapiens purinergic receptor P2Y, G-protein coupled, 5 (P2RY5), mRNA [NM_005767] |
| 291 | A_23_P29005 | SAMSN1 | CTCTGGTTGCTATATGTCATCAGGAAATTGAGATAATGGGAAAGAGGATGTGAGTCTGA | SEQ ID NO: 1872 | Homo sapiens SAM domain, SH3 domain and nuclear localization signals 1 (SAMSN1), mRNA [NM_022136] |
| 292 | A_23_P302550 | RGS18 | GAGTCTAAGGCCGTACGGATTTGGGCATGTGCCACATGGTTCATATTGCAGAAAGTGTTA | SEQ ID NO: 1873 | Homo sapiens regulator of G-protein signalling 18 (RGS18), mRNA [NM_130782] |
| 293 | A_23_P30307 | CRSP9 | CAATTGTTACTGGACAGAATGAACATGAAAGAGAAAAATTCAGGTGATAGGAGATCAGAT | SEQ ID NO: 1874 | Homo sapiens cofactor required for Sp1 transcriptional activation, subunit 9, 33kDa (CRSP9), mRNA [NM_004270] |
| 294 | A_23_P305140 | C10orf32 | AAATGGGACTCTATATGTTGTTAGTTCAGGTCTGTTCATTGACTAAGAGATTGAGAGAAATC | SEQ ID NO: 1875 | Homo sapiens chromosome 10 open reading frame 32 (C10orf32), mRNA [NM_144591] |
| 295 | A_23_P307840 | CAPZA2 | CTACAAGATTGGCAAAGATGCAGAATGCAGTAATGAGAACATCATGAGCGGGATCATT | SEQ ID NO: 1876 | Homo sapiens capping protein (actin filament) muscle Z-line, alpha 2 (CAPZA2), mRNA [NM_006136] |
| 296 | A_23_P308800 | GLS | CGGAAGAAGAGATAAGATACTGCGGAATAGGCCGTCAAACTTAAAAAAGAAAAAACTTTGC | SEQ ID NO: 1877 | Homo sapiens glutaminase C mRNA, complete cds. [AF158555] |
| 297 | A_23_P30955 | KIAA0776 | TTTTTTCATTGTCAAAATGCTTCTTTGTTGCCAGAGTAAAGAACAGTTTTTATGTT | SEQ ID NO: 1878 | Homo sapiens KIAA0776 (KIAA0776), mRNA [NM_015323] |
| 298 | A_23_P31097 | OSTM1 | ACTGAAAATGTGCTGGGGTTTGTCTGTCGTCACTGTTTATGCTGCTGAACTTAGGCACT | SEQ ID NO: 1879 | Homo sapiens osteopetrosis associated transmembrane protein 1 (OSTM1), mRNA [NM_014028] |
| 299 | A_23_P312246 | CCDC82 | GGCTTTATAACGACGATGACTGTCAAGTGAATGAGCTGTTGATATCCTGTCAGTTTAGTGAA | SEQ ID NO: 1880 | Homo sapiens coiled-coil domain containing 82 (CCDC82), mRNA [NM_024725] |
| 300 | A_23_P314191 | ZDHHC17 | TGGATACTTTTAGGCAAATAGGAAGCTTAATTCTCAGCACTGAACATGAATTACTTCCTGG | SEQ ID NO: 1881 | Homo sapiens zinc finger, DHHC-type containing 17 (ZDHHC17), mRNA [NM_015336] |
| 301 | A_23_P314591 | NFYB | GGAGGGATTTACTAACCAGTTACCAGCTGCGTTAATAACCACAGACGGTCAACAACAAAA | SEQ ID NO: 1882 | Homo sapiens nuclear transcription factor Y, beta (NFYB), mRNA [NM_006166] |
| 302 | A_23_P31571 | UQCRB | AAGGCATAAGAAGACTTCCTGAAGACACGTTATAATGAAGAGGATGTTTCGGATTAAGAGGG | SEQ ID NO: 1883 | Homo sapiens ubiquinol-cytochrome c reductase binding protein (UQCRB), mRNA [NM_006294] |
| 303 | A_23_P31702 | PXMP3 | CTTCTCTGGCATGGTTTTGCTGAATTTCTGATTTCTGTCTTACCACTTATCAATGTCCAG | SEQ ID NO: 1884 | Homo sapiens peroxisomal membrane protein 3, 35kDa (Zellweger syndrome) (PXMP3), transcript variant 1, mRNA [NM_000318] |
| 304 | A_23_P317347 | ESCO1 | GCTAATTTTAAAAGGCCTGAACTATACTTTGAAGAAACCCTATAGAAAAGGAAAGCTC | SEQ ID NO: 1885 | Homo sapiens establishment of cohesion 1 homolog 1 (S. cerevisiae) (ESCO1), mRNA [NM_052911] |

Fig. 5-17

| No. | Probe ID No. | Symbols of genes | Sequence | SEQ ID NO: | Descriptions of genes (letters and numbers within [ ] indicates GenBank accession No.) |
|---|---|---|---|---|---|
| 305 | A_23_P319133 | DNAJC10 | TCTAGGAAAGGGATCTTCTAGTTTCTGTGTTGTTTAGACTCAAAG AATCACAAATTTGTC | SEQ ID NO: 1886 | Homo sapiens DnaJ (Hsp40) homolog, subfamily C, member 10 (DNAJC10), mRNA [NM_018981] |
| 306 | A_23_P3204 | MAPK6 | AACGTGGTCACTGTGTATAGGAATTTGTATTTTGGAGGTGCTTGA TCTATCTAGAAAGAA | SEQ ID NO: 1887 | Homo sapiens mitogen-activated protein kinase 6 (MAPK6), mRNA [NM_002748] |
| 307 | A_23_P324633 | C9orf72 | TTTGTGGAATTTAGTCCCTGGGATTGAGTCTGTAGAAAATGTCTAAT AGTTCTGTATAGTCC | SEQ ID NO: 1888 | Homo sapiens chromosome 9 open reading frame 72 (C9orf72), transcript variant 1, mRNA [NM_018325] |
| 308 | A_23_P327022 | MDFIC | TTATGATTTGTTAATGTAAATGTTTGTTGAAGTATATGGCTAT CATGACTAAGTGCTA | SEQ ID NO: 1889 | Homo sapiens MyoD family inhibitor domain containing (MDFIC), mRNA [NM_199072] |
| 309 | A_23_P33045 | RPL26 | TACAAAGGTCAGCAAATTGGCAAAGTAGTCCAGGTTTACAGGAAAG AAATATGTTATCTAC | SEQ ID NO: 1890 | Homo sapiens ribosomal protein L26 (RPL26), mRNA [NM_000987] |
| 310 | A_23_P332439 | NUPL1 | ATTGAAAATCTTGAATGTATTGAATCTGTCAAGGTACAGACGGGTG CCTTTGTCAAATGTTC | SEQ ID NO: 1891 | Homo sapiens KIAA0410 mRNA, partial cds. [AB007870] |
| 311 | A_23_P339480 | HAT1 | AACATGAACATGGTGGAAGAGAGTTTCAGGAACTAGTAGGAAGATT ACCGGCGTGTTATTG | SEQ ID NO: 1892 | Homo sapiens histone acetyltransferase 1 (HAT1), mRNA [NM_003642] |
| 312 | A_23_P341448 | ZDHHC20 | TGTGAGTTAATGTTGAATGCTTGCTTGTCTTTGGCTGGCCTAA CCTACATTGACATGT | SEQ ID NO: 1893 | Homo sapiens cDNA FLJ25952 fis, clone SYNO0911. [AK098818] |
| 313 | A_23_P34307 | PIGK | ATTCATTTGCAGAGTCTTCTATTGTTGGACCAGTTACATTGTACCA AATGTTTCGTTTGG | SEQ ID NO: 1894 | Homo sapiens phosphatidylinositol glycan anchor biosynthesis, class K (PIGK), mRNA [NM_005482] |
| 314 | A_23_P345591 | PSMA2 | GCCTGGAAACGTACAGCAATGGGAAAGAAGTACTATGTGAATGGGAAG ACTTTGCTTGAAGAA | SEQ ID NO: 1895 | Homo sapiens proteasome (prosome, macropain) subunit, alpha type, 2 (PSMA2), mRNA [NM_002787] |
| 315 | A_23_P347059 | MOBKL1A | CTAGAAGGGGAAAAATCATCTAAGTTATGAAATCCAACATAGGCG CTATATTACAAACTG | SEQ ID NO: 1896 | Homo sapiens MOB1, Mps One Binder kinase activator-like 1A (yeast) (MOBKL1A), mRNA [NM_173468] |
| 316 | A_23_P347198 | SP3 | GACCACGTCAAATTTAAAGGCTACGTTATTGTACGTTTAAAGTGT ATTATAACAGTGTGG | SEQ ID NO: 1897 | Homo sapiens Sp3 transcription factor (SP3), transcript variant 1, mRNA [NM_003111] |
| 317 | A_23_P349083 | FCHO2 | GTGAAATGGTTAAACTTCTGCACTTGTTAGTTACCAGCAGTCTTC ATACCAAGTATTGGG | SEQ ID NO: 1898 | Homo sapiens FCH domain only 2 (FCHO2), mRNA [NM_138782] |
| 318 | A_23_P351457 | CMAH | GCTTAAATTTGTGGATCACTAGATAGGCAGATTCAAAAATATTT AGTTGTTCCATCCAC | SEQ ID NO: 1899 | Homo sapiens cytidine monophosphate-N-acetylneuraminic acid hydroxylase (CMP-N-acetylneuraminate monooxygenase) (CMAH) on chromosome 6 (NR_002174] |
| 319 | A_23_P351903 | TMEM167 | AAACTGGATTGTTGGGTATATTTTGGAAGTGTGCCAGAATTGGTG AACGGAAGAGTCCTT | SEQ ID NO: 1900 | Homo sapiens transmembrane protein 167 (TMEM167), mRNA [NM_174909] |
| 320 | A_23_P353704 | RP5-1022P6.2 | TGTCTCTGACTACCTATTACACACGTGTTGCTTGTTGGGTTTGTTT TGTATGTGCGTGTGT | SEQ ID NO: 1901 | Homo sapiens hypothetical protein KIAA1434 (KIAA1434), mRNA [NM_019593] |
| 321 | A_23_P354894 | ZNF567 | ACCTAAGAGTTACGAGTTCCGGTAGCCTATAACATCAAAAGTAGT TTTTGACATGTTTCA | SEQ ID NO: 1902 | Homo sapiens zinc finger protein 567 (ZNF567), mRNA [NM_152603] |
| 322 | A_23_P355067 | TMCO1 | AACTCAAGAACTCTTTATTTTCTATCATTCTTTCTACACACAC ACATCAGAGCTGGCAA | SEQ ID NO: 1903 | Homo sapiens transmembrane and coiled-coil domains 1 (TMCO1), mRNA [NM_019026] |
| 323 | A_23_P355244 | SAMD9 | TCACTGGAGGAAGAATTTTCCGTTGCTCTGCATAAAATTTAACT CCATAACTTATAAGC | SEQ ID NO: 1904 | Homo sapiens sterile alpha motif domain containing 9 (SAMD9), mRNA [NM_017654] |
| 324 | A_23_P356122 | ZNF451 | TTTTACCTGCTTAGACTTTTATGTGACTTGTAGTGGTCTCTGTT AAAGGGAATGGTGTC | SEQ ID NO: 1905 | Homo sapiens zinc finger protein 451 (ZNF451), transcript variant 2, mRNA [NM_015555] |

Fig. 5-18

| No. | Probe ID.No. | Symbols of genes | Sequence | SEQ ID NO: | Descriptions of genes (letters and numbers within [ ] indicates GenBank accession No.) |
|---|---|---|---|---|---|
| 325 | A_23_P358470 | CCDC111 | ATGACCCTGTATGTAAAGCAGAAAACTTCAAATCTGACTGTTTCCATTACCTGGTGAAG | SEQ ID NO: 1906 | Homo sapiens coiled-coil domain containing 111 (CCDC111), mRNA [NM_152683] |
| 326 | A_23_P358628 | DPY19L1 | ATATAAATTAGGCTTTTTCAAGAAGGATCGTTTTGTAGGAGTGTTTATAATGTAACGCCC | SEQ ID NO: 1907 | Homo sapiens DPY-19-like protein 1 (DPY19L1) mRNA, complete cds. [DQ287932] |
| 327 | A_23_P361448 | SESN3 | AAGGAGAAGAAAGAAAGTCTTTTGTGGTCTCTGGAGATAGTTTCATTGATTCCTCAT | SEQ ID NO: 1908 | Homo sapiens sestrin 3 (SESN3), mRNA [NM_144665] |
| 328 | A_23_P364107 | C14orf106 | AGGAGACAGTGTTGTGTATTTTGAACTGGAGTACATGTATTTTCTTTGTAAAGTAGGTCC | SEQ ID NO: 1909 | Homo sapiens chromosome 14 open reading frame 106 (C14orf106), mRNA [NM_018363] |
| 329 | A_23_P36776 | PUS7L | GGGCTTCAGTTTCAACATCGTAAAATGGGATGTTAACATTGCCTACCTCATAGGATTA | SEQ ID NO: 1910 | Homo sapiens pseudouridylate synthase 7 homolog (S. cerevisiae)-like (PUS7L), mRNA [NM_031292] |
| 330 | A_23_P3681 | NETO2 | AGACCTTAGGAAATGTGGACATAAGCTCTTCTTTGTTTGGTTTTTGTTACTGTATTTAGTTTGTG | SEQ ID NO: 1911 | Homo sapiens neuropilin (NRP) and tolloid (TLL)-like 2 (NETO2), mRNA [NM_018092] |
| 331 | A_23_P368681 | GIMAP2 | ATGACCAAGTGAAGGAACTAATGGACTGTGTATTGAAGATCTGTTGATGGAGAAAAATGGTG | SEQ ID NO: 1912 | Homo sapiens GTPase, IMAP family member 2 (GIMAP2), mRNA [NM_015660] |
| 332 | A_23_P371266 | DNM3 | ACTGTCTTCTTGGCAGTTTCAGGATTCCTTAATGCTGATACATATGGACTCTTAGAATGGAA | SEQ ID NO: 1913 | Homo sapiens dynamin 3 (DNM3), mRNA [NM_015569] |
| 333 | A_23_P37275 | CGRRF1 | GAGCAAGATAAAGACAAAACCGAAGACTCTTGAAGACTATCAACACTGAAAAGTACACT | SEQ ID NO: 1914 | Homo sapiens cell growth regulator with ring finger domain 1 (CGRRF1), mRNA [NM_006568] |
| 334 | A_23_P37441 | B2M | TTGTCTTCAGCAAGGACTGGTCTTCTTCTTGTATCTCTTGTACTACACTGAATTCAGCGCACT | SEQ ID NO: 1915 | Homo sapiens beta-2-microglobulin (B2M), mRNA [NM_004048] |
| 335 | A_23_P37636 | FAM96A | CTTGAACCTGACTGACTGATAGCTGTTTTAAGAGCCACTGCGGCCTGTAATTGTTTGATATATTTG | SEQ ID NO: 1916 | Homo sapiens family with sequence similarity 96, member A (FAM96A), transcript variant 1, mRNA [NM_032231] |
| 336 | A_23_P380848 | TXNL5 | CTGGTGGAAATGTGTTCTCTGAAGATTAAGATTTAGGATGGCAATCATGTCTTGATGT | SEQ ID NO: 1917 | Homo sapiens thioredoxin-like 5 (TXNL5), mRNA [NM_032731] |
| 337 | A_23_P38275 | THC2504576 | TCTCGGCCAAATGAAGTTTAATCCCTTGTGACTTCCGACCGAAGCAAGAATGGCAATGA | SEQ ID NO: 1918 | RL26_BOVIN (P61257) 60S ribosomal protein L26, complete [THC2504576] |
| 338 | A_23_P384056 | CCDC14 | TAGCTGAGTATCATCTCCGTTCATGTAAGCAGCACGTTTTAACTCTTAGGAAGCTGAATG | SEQ ID NO: 1919 | Homo sapiens coiled-coil domain containing 14 (CCDC14), mRNA [NM_022757] |
| 339 | A_23_P390734 | FGFR1OP2 | CCACCAGATACAGAAATGTCCTTTAAGATCAGTTGAAACCTAAATTTTCTTATGTGTGG | SEQ ID NO: 1920 | Homo sapiens FGFR1 oncogene partner 2 (FGFR1OP2), mRNA [NM_015633] |
| 340 | A_23_P394276 | RWDD4A | TTGTCAGGGCTTAATTATGGCGTTGTAATCAGAGAATGATGCTAGTTACATGCCAATGA | SEQ ID NO: 1921 | Homo sapiens RWD domain containing 4A (RWDD4A), mRNA [NM_152682] |
| 341 | A_23_P394605 | SEC24A | GATTTATTTCTTCTAATCAAAGATGGATAACAGTGTATTATCTAGGGAACCACCAAATGTG | SEQ ID NO: 1922 | Homo sapiens SEC24 related gene family, member A (S. cerevisiae) (SEC24A), mRNA [NM_021982] |
| 342 | A_23_P397899 | FZD5 | GGGAGCTTACAATCCTAAGGTTGGCGTTGTAATGAAGTTCCACTTGGTTCAGGTTTCTT | SEQ ID NO: 1923 | Homo sapiens frizzled homolog 5 (Drosophila) (FZD5), mRNA [NM_003468] |
| 343 | A_23_P410017 | TBCEL | ATACAGTTCATGTAAAGGGAAGGCTTCTCATTTAATTCAGGGGATGTGGGTATTTTAGG | SEQ ID NO: 1924 | Homo sapiens leucine rich repeat containing 35, mRNA (cDNA clone IMAGE:3913004). [BC020501] |
| 344 | A_23_P41114 | CSTA | AAACAAATTGAGACTTATGGAAAATTGGAAGCTGTGCAGTATAAACTCAAGTTGTTGCTG | SEQ ID NO: 1925 | Homo sapiens cystatin A (stefin A) (CSTA), mRNA [NM_005213] |
| 345 | A_23_P413796 | CCDC5 | GCATGGATGCTTCTCTGTCTCATCAGTCGTTAGTAGCAGTATCAGAGAAAGTGGCAAGAT | SEQ ID NO: 1926 | Homo sapiens coiled-coil domain containing 5 (spindle associated) (CCDC5), mRNA [NM_138443] |

Fig. 5-19

| No. | Probe ID No. | Symbols of genes | Sequence | SEQ ID NO: | Descriptions of genes (letters and numbers within [ ] indicates GenBank accession No.) |
|---|---|---|---|---|---|
| 346 | A_23_P41512 | C4orf15 | TAAGGCTGTTAGTCTTGAAGATTGAAAATTACTGAAAACTGAATCTTTATTACGTGTCCT | SEQ ID NO: 1927 | Homo sapiens chromosome 4 open reading frame 15 (C4orf15), mRNA [NM_024511] |
| 347 | A_23_P41645 | ELL2 | TGTCTTTTCAAAGTGCTGCCAGTTGAAAAGGGGAAGGATTATGTTTACAAATCTGTTTTGA | SEQ ID NO: 1928 | Homo sapiens elongation factor, RNA polymerase II, 2 (ELL2), mRNA [NM_012081] |
| 348 | A_23_P41664 | ENST00000334994 | TGGCTTGGAGCAGATTCGACTTCATAAAGACAAATTGTTCCTGAAAATGAGGCACAAGGTCAT | SEQ ID NO: 1929 | Syntaurin [Source:Uniprot/SPTREMBL:Acc:Q72207] [ENST00000334994] |
| 349 | A_23_P421563 | LSM3 | CATAAGAGAAACTGCATACATTTGATATTAAGAAATAATTCGGGGGATTCTTCCACTC | SEQ ID NO: 1930 | Homo sapiens LSM3 homolog, U6 small nuclear RNA associated (S. cerevisiae) (LSM3), mRNA [NM_014463] |
| 350 | A_23_P422794 | NSMCE2 | CATTGTTCGGATCATGATTGAGTGCAGGCAAAAAGCGGAAGAAAAAGGCCTATTGCCCTCAAAT | SEQ ID NO: 1931 | Homo sapiens non-SMC element 2, MMS21 homolog (S. cerevisiae) (NSMCE2), mRNA [NM_173685] |
| 351 | A_23_P42718 | NFE2L3 | CAGGCAATCGTTTTAAGAGTAAGTTGGTTACTTCAAAAAGAGCAAAGACTGGGATCAAA | SEQ ID NO: 1932 | Homo sapiens nuclear factor (erythroid-derived 2)-like 3 (NFE2L3), mRNA [NM_004289] |
| 352 | A_23_P428468 | ENST00000369677 | AAACCTACGGTCAGTCTGAAAAAACTGAAGTACATTGAAATGATCCAGATATGTCTGTT | SEQ ID NO: 1933 | Zinc finger protein 292 [Source:Uniprot/SWISSPROT:Acc:060281] [ENST00000369677] |
| 353 | A_23_P429491 | FLJ25416 | GCTTGGTCACCTGGAATTGTTTCATAAAAAGTCAGCTGAACCCAATTCCTGAACTTTTAA | SEQ ID NO: 1934 | Homo sapiens hypothetical protein FLJ25416 (FLJ25416), mRNA [NM_145018] |
| 354 | A_23_P42975 | PRKAR2B | GCCACATTTTTAGAACAGTGTTTAAGACATTTTTTGCAAAAGCTTCTTGTAGGAAAAGAGAGC | SEQ ID NO: 1935 | Homo sapiens protein kinase, cAMP-dependent, regulatory, type II, beta (PRKAR2B), mRNA [NM_002736] |
| 355 | A_23_P43049 | DCTN6 | AAATAGATTTGAAGTCATCCCGTGAGAATACGGTGATCTATGCTGCAGAGTGCTTCGGTCG | SEQ ID NO: 1936 | Homo sapiens dynactin 6 (DCTN6), mRNA [NM_006571] |
| 356 | A_23_P43150 | ZHX1 | TTTGTAAAGACTGGTGGTCGTGTTCATTCATATATGGGAAGACCCTTTCTTGTGACGATAGG | SEQ ID NO: 1937 | Homo sapiens zinc fingers and homeoboxes 1 (ZHX1), transcript variant 1, mRNA [NM_010179261] |
| 357 | A_23_P43157 | MYBL1 | ATACATATTTGGGTTGGTTGGTACTGGTTGAATCCTTCAGTTAAGCTGCTTTGTTGCTTTTTGCA | SEQ ID NO: 1938 | Homo sapiens v-myb myeloblastosis viral oncogene homolog (avian)-like 1 (MYBL1), mRNA [NM_001080416] |
| 358 | A_23_P43175 | SEPT10 | AAATGCACATAATTCATATATTCAGGTGGTATTTCAGTGCATTCAGTGCCTTACTGGTATTCTCA | SEQ ID NO: 1939 | Homo sapiens septin 10 (SEPT10), transcript variant 1, mRNA [NM_144710] |
| 359 | A_23_P433111 | C5orf35 | GTTCCAATGACAGAGGAGGAGTAATGTCTGTTATCACGAATTTGATGTGCCTGCAGTTTCC | SEQ ID NO: 1940 | Homo sapiens chromosome 5 open reading frame 35 (C5orf35), mRNA [NM_153706] |
| 360 | A_23_P434809 | S100A8 | AAAGCCATGAAGAAAGCACAGAAGAGTAGCTGAGTTACTGGGGCCCAGAGGCTGGGCCCCT | SEQ ID NO: 1941 | Homo sapiens S100 calcium binding protein A8 (S100A8), mRNA [NM_002964] |
| 361 | A_23_P44257 | COMMD8 | AACATTTTACTTCTCGGCTTCGTGTATGTTTGGGAAACATTGCTCTGATAAAAATAGCTGTC | SEQ ID NO: 1942 | Homo sapiens COMM domain containing 8 (COMMD8), mRNA [NM_017845] |
| 362 | A_23_P44974 | MRPL13 | ATGAGGTAAAACAACTGCTACAGTTCAGACACCGTGTTTTATGTGCCGAATCACTGTGGGGA | SEQ ID NO: 1943 | Homo sapiens mitochondrial ribosomal protein L13 (MRPL13), nuclear gene encoding mitochondrial protein, mRNA [NM_014078] |
| 363 | A_23_P45180 | GYPA | ACCTGCTAAGTTGTACAATTTCAGAATGCAATTTCATTATAATGAGTTCCAGTGACTC | SEQ ID NO: 1944 | Homo sapiens glycophorin A (MNS blood group) (GYPA), mRNA [NM_002099] |

Fig. 5-20

| No. | Probe ID No. | Symbols of genes | Sequence | SEQ ID NO: | Descriptions of genes (letters and numbers within [ ] indicates GenBank accession No.) |
|---|---|---|---|---|---|
| 364 | A_23_P45248 | SH2D1A | TTCTAAAGGCATTGTAGTCGTGTAATGGAAGGCATGTAGCATGTCGG TCAAAGCTGAAATGG | SEQ ID NO: 1945 | Homo sapiens SH2 domain protein 1A, Duncan's disease (lymphoproliferative syndrome) (SH2D1A), mRNA [NM_002351] |
| 365 | A_23_P45934 | SRP9 | TATACGGATTGTGATGGGAACTTGTGTGTTAAAGTAACAGATGAT TAGTTTGTTTGGTG | SEQ ID NO: 1946 | Homo sapiens signal recognition particle 9kDa (SRP9), mRNA [NM_003133] |
| 366 | A_23_P46396 | PTBP2 | AACCAGGTGGGACCAAAGTTTATGTGCCTTAGTCTTAATTACC TTGCATTGTAATATT | SEQ ID NO: 1947 | Homo sapiens polypyrimidine tract binding protein 2 (PTBP2), mRNA [NM_021190] |
| 367 | A_23_P48166 | TWF1 | TGGAGGACGACCATAGCTGAAGCTGTTATTTTCAGTCAGGAAGACT ACCGTGTCATGAAGGT | SEQ ID NO: 1948 | Homo sapiens twinfilin, actin-binding protein, homolog 1 (Drosophila) (TWF1), mRNA [NM_002822] |
| 368 | A_23_P48180 | ZNF92 | GAATATTAAGTGCCTACTTGAGGTAGATGTTCAGACTAACATTGTT TTGCAGTATAGTGAG | SEQ ID NO: 1949 | Homo sapiens zinc finger protein 92 (ZNF92), transcript variant 1, mRNA [NM_007139] |
| 369 | A_23_P51276 | TUBB2A | GTGGACGAGGAGATGCTGGAACGGTGCAGAACAAGAACAGCAGCTAC TTCGTGAGTGGATC | SEQ ID NO: 1950 | Homo sapiens tubulin, beta 2A (TUBB2A), mRNA [NM_001069] |
| 370 | A_23_P502425 | MRPL47 | GTTTCCACATCTTGCTGAAGGCCAAAAGTCAAGTCTGTCTAAGA TGTCTGAACTATTAA | SEQ ID NO: 1951 | Homo sapiens mitochondrial ribosomal protein L47 (MRPL47), nuclear gene encoding mitochondrial protein, transcript variant 1, mRNA [NM_020409] |
| 371 | A_23_P502797 | WDFY1 | GTAACAGTTTACTGGTTGTTCCATTGCTGAATATGCAGGCTAATT TGTACAGATAGGGAT | SEQ ID NO: 1952 | Homo sapiens WD repeat and FYVE domain containing 1 (WDFY1), mRNA [NM_020830] |
| 372 | A_23_P50907 | ITGAV | AAAGAGTGATTAAGTGAGGTTATTTTACCGGTAAATGGTCGATTCT GGATTGTATTTCAGG | SEQ ID NO: 1953 | Homo sapiens integrin, alpha V (vitronectin receptor, alpha polypeptide, antigen CD51) (ITGAV), mRNA [NM_002210] |
| 373 | A_23_P51009 | NDUFB3 | CCGGAATGAAGCTTGCAGATACATGGGATGGCTTTGCAAAGAGTGT TTCCTTTTCTGATGT | SEQ ID NO: 1954 | Homo sapiens NADH dehydrogenase (ubiquinone) 1 beta subcomplex, 3, 12kDa (NDUFB3), mRNA [NM_002491] |
| 374 | A_23_P51317 | CCDC76 | CCCTTGTTTATAAGTTTATGTCAAGTAAGGTAAGGTAGTTTGTTTTAAGTT AGTTACCCATGTCCC | SEQ ID NO: 1955 | Homo sapiens coiled-coil domain containing 76 (CCDC76), mRNA [NM_019083] |
| 375 | A_23_P51487 | GBP3 | AATCCTAAAGGATAAGTAAGTTAGTCTTTCCTGATTCTTAAAGGTGAT ACTTGAAATCCTGCC | SEQ ID NO: 1956 | Homo sapiens guanylate binding protein 3 (GBP3), mRNA [NM_018284] |
| 376 | A_23_P53668 | NFYB | TGGGCTGATATTCCAGGTATTCCATCTGTGGATGAAAGTAACAATGTT TAACATATATTGGG | SEQ ID NO: 1957 | Homo sapiens nuclear transcription factor Y, beta (NFYB), mRNA [NM_006166] |
| 377 | A_23_P53957 | C14orf112 | TTATACTTCCAGCTATTCCGATCGTGTGGATGAAAGTAACAATGTT GGGCACGTATATTT | SEQ ID NO: 1958 | Homo sapiens chromosome 14 open reading frame 112 (C14orf112), mRNA [NM_016468] |
| 378 | A_23_P56050 | TNNT1 | TCCGAGCGTAAGAAGCCTCGGACATTGACTAGATGGGAGGAGGAA CAGGTCCGGGGAGAAA | SEQ ID NO: 1959 | Homo sapiens troponin T type 1 (skeletal, slow), mRNA (cDNA clone MGC:104241 IMAGE:4247379), complete cds, [BC107798] |
| 379 | A_23_P5611 | RIF1 | ATGTATTCTTGGCTGCTAGTGCGTGGTTTTCAGGAAATTTAATTA TCTTACTGAGATGTG | SEQ ID NO: 1960 | Homo sapiens RAP1 interacting factor homolog (yeast) (RIF1), mRNA [NM_018151] |
| 380 | A_23_P56380 | ZC3H15 | GTCCACCCAAGTAAGAAAGTGTATCGTCCTTCCATCGTTTTGGTTT TCATTTGGGCATGTG | SEQ ID NO: 1961 | Homo sapiens zinc finger CCCH-type containing 15 (ZC3H15), mRNA [NM_018471] |
| 381 | A_23_P56734 | HNMT | CCTTTTGTCCACGATGGATATATATCTGACTGCTTTATTGATGGTAA TCAAAATGGAGACCT | SEQ ID NO: 1962 | Homo sapiens histamine N-methyltransferase (HNMT), transcript variant 1, mRNA [NM_006895] |
| 382 | A_23_P56759 | KRCC1 | GATATCCGTGTTCATACCACTTTCTTATGTGAATAAGGTTGTTTA AGTTGTAACAAAGGC | SEQ ID NO: 1963 | Homo sapiens lysine-rich coiled-coil 1 (KRCC1), mRNA [NM_016618] |

Fig. 5-21

| No. | Probe ID No. | Symbols of genes | Sequence | SEQ ID NO: | Descriptions of genes (letters and numbers within [ ] indicates GenBank accession No.) |
|---|---|---|---|---|---|
| 383 | A_23_P57277 | C21orf7 | CCAGCTTCTAGCTTGAGGAAGGATATTTTAAATGAGATCATTAACGTGAAAGTATTAC | SEQ ID NO: 1964 | Homo sapiens chromosome 21 open reading frame 7 (C21orf7), mRNA [NM_020152] |
| 384 | A_23_P58390 | C4orf32 | TAATACTAACTATTTAGTATAGTGTCAGTAGTGTACATCTGTGCAGACTGGTGTTAATAGGG | SEQ ID NO: 1965 | Homo sapiens chromosome 4 open reading frame 32 (C4orf32), mRNA [NM_152400] |
| 385 | A_23_P58396 | PDGFC | CATGGATATTTTTATGTACAGAAGTATGTCTCTTAACCAGTTCACTTATTGTAGTCTGGC | SEQ ID NO: 1966 | Homo sapiens platelet derived growth factor C (PDGFC), mRNA [NM_016205] |
| 386 | A_23_P58877 | GOPC | AAGGTTCATGTGATTCATGTCTGTAAGATGCACAGTATTTGACATCCTGATTATGTAATCC | SEQ ID NO: 1967 | Homo sapiens golgi associated PDZ and coiled-coil motif containing (GOPC), transcript variant 1, mRNA [NM_020399] |
| 387 | A_23_P58912 | SLC35A1 | ATGATCAGTGCGGTTATGTGGAAAACAAGAAACAAAACAAAGAAAGCTATCTGAGTGAACTGC | SEQ ID NO: 1968 | Homo sapiens solute carrier family 35 (CMP-sialic acid transporter), member A1 (SLC35A1), mRNA [NM_006416] |
| 388 | A_23_P59637 | DOCK4 | TTTGGCAGTGAGGAGTGAGTGTGAATTTATCTTGAATTTATCATGTGTGTGTATTTCTGAAGCAG | SEQ ID NO: 1969 | Homo sapiens dedicator of cytokinesis 4 (DOCK4), mRNA [NM_014705] |
| 389 | A_23_P59921 | SUB1 | CAGAATTGGGAAAATGAGGTTAGTGTTCGGCATTTTAAAGGCAAAGTGCTAATTGAT | SEQ ID NO: 1970 | Homo sapiens SUB1 homolog (S. cerevisiae) (SUB1), mRNA [NM_006713] |
| 390 | A_23_P60248 | TXN | GGACAAAAGGTGGGTGAATTTCTGGAGCCAATAAGGAAAAGGTTGAAGCCAGCATTAAT | SEQ ID NO: 1971 | Homo sapiens thioredoxin (TXN), mRNA [NM_003329] |
| 391 | A_23_P61674 | CLK4 | GAAAGGCATGCAGTTTGTCCATTGTGAGAGTTTGTTTAATAAACCACATACACACTTTA | SEQ ID NO: 1972 | Homo sapiens CDC-like kinase 4 (CLK4), mRNA [NM_020666] |
| 392 | A_23_P63655 | ATP5C1 | AGAGAGCTGAAACAGGCTCGGAATATATGGGATCTTAGCTCTGTATGAAAAAGCT | SEQ ID NO: 1973 | Homo sapiens ATP synthase, H+ transporting, mitochondrial F1 complex, gamma polypeptide 1 (ATP5C1), nuclear gene encoding mitochondrial protein, transcript variant 2, mRNA [NM_005174] |
| 393 | A_23_P63868 | IFIT5 | AAGATAGATCAGAAAATGCAGAATTCCTGACTGCTCTCTGTGAGCTCCGACTTTCCATT | SEQ ID NO: 1974 | Homo sapiens interferon-induced protein with tetratricopeptide repeats 5 (IFIT5), mRNA [NM_012420] |
| 394 | A_23_P63886 | FAS | ATGTCTATCCACAGAGGCTAACGCCACTCTATGAATCAATAGAAGAAGCTATGACGTTTTGC | SEQ ID NO: 1975 | Homo sapiens Fas (TNF receptor superfamily, member 6) (FAS), transcript variant 1, mRNA [NM_000043] |
| 395 | A_23_P65230 | TMTC4 | AGAAGGCAACACATCTGTGTAAGCTGCTTTTTAGTGTGTTTATCTGAAGGCGGTTTTTCCA | SEQ ID NO: 1976 | Homo sapiens transmembrane and tetratricopeptide repeat containing 4 (TMTC4), transcript variant 1, mRNA [NM_032813] |
| 396 | A_23_P65768 | C15orf15 | TCCTGCATTGCCATCTACATAATAATACAGATATTACGGATGTGTTAGATTGCATCTCAGTGTT | SEQ ID NO: 1977 | Homo sapiens chromosome 15 open reading frame 15 (C15orf15), mRNA [NM_016304] |
| 397 | A_23_P66260 | ZNF267 | TGTGATGAATGTGGTAAAGCGTTCAGGTATAGGCATACGTCACTACACATGGGAGAAGT | SEQ ID NO: 1978 | Homo sapiens zinc finger protein 267 (ZNF267), transcript variant 498723, mRNA [NM_003414] |
| 398 | A_23_P68472 | DPM1 | CTATTGGCAGAGGTTCGAATATCATTTGTGGATCGTGTTTATGGTGAATCCAAGTTGGGAG | SEQ ID NO: 1979 | Homo sapiens dolichyl-phosphate mannosyltransferase polypeptide 1, catalytic subunit (DPM1), mRNA [NM_003859] |
| 399 | A_23_P69109 | PLSCR1 | GTTAGCTCTTACACTCTATCCTTCCTAGAAAATGGTAATTGAGATTACTCAGATATTAA | SEQ ID NO: 1980 | Homo sapiens phospholipid scramblase 1 (PLSCR1), mRNA [NM_021105] |
| 400 | A_23_P69685 | ZCD2 | ATTTGTCTTACTAAGAGGAGGTTATTGTGAGGTGTTGGCGTTGTAAAACGTTTCCTGCCT | SEQ ID NO: 1981 | Homo sapiens zinc finger, CDGSH-type domain 2 (ZCD2), mRNA [NM_001008388] |

Fig. 5-22

| No. | Probe ID No. | Symbols of genes | Sequence | SEQ ID NO: | Descriptions of genes (letters and numbers within [ ] indicates GenBank accession No.) |
|---|---|---|---|---|---|
| 401 | A_23_P69908 | GLRX | GTGATAAAAGTTAGAGCCCCCTAGACAGCGAAGAGTCTATCTGTGAAAGAGCCCTACACTT | SEQ ID NO: 1982 | Homo sapiens glutaredoxin (thioltransferase) (GLRX), mRNA [NM_002064] |
| 402 | A_23_P70290 | TMEM30A | ATCTTGTGCCTGCAACTGTAAACCAGATGTAAGTGCTTAATGAGACTGTTTTCATTCTTG | SEQ ID NO: 1983 | Homo sapiens transmembrane protein 30A (TMEM30A), mRNA [NM_018247] |
| 403 | A_23_P70318 | ENPP4 | TGTTTTTTGGGTGTCTCCTTCTTGTGCGCATATCTGATAAGGCTTATGGATTATTGCATTT | SEQ ID NO: 1984 | Homo sapiens ectonucleotide pyrophosphatase/phosphodiesterase 4 (putative function) (ENPP4), mRNA [NM_014936] |
| 404 | A_23_P70328 | CENPQ | CAATGGCTTACAGATTTGTGTGTGGTCATCTGGAAGTTGAAAAATCCTCAAATGCCTTCAG | SEQ ID NO: 1985 | Homo sapiens centromere protein Q (CENPQ), mRNA [NM_018132] |
| 405 | A_23_P7066 | RPL9 | GGTCTCTTGTTGAAATCCGAAATTTCTTGGGTGAAAAATATCCGCAGGGTTCCAATGA | SEQ ID NO: 1986 | Homo sapiens ribosomal protein L9 (RPL9), transcript variant 1, mRNA [NM_000661] |
| 406 | A_23_P70938 | STARD3NL | GCATTATGTGTATGGCCTGAAGTGTTGGACTTGCAAAAGGGGGAAGAAAGGAATTGGGAAT | SEQ ID NO: 1987 | Homo sapiens STARD3 N-terminal like (STARD3NL), mRNA [NM_032016] |
| 407 | A_23_P71433 | UBE2W | CATGAGCCCTACTGCCTAAAGACTATTTCATTTATTTATGTTGGAAACCCGGGTAAACAT | SEQ ID NO: 1988 | Homo sapiens ubiquitin-conjugating enzyme E2W (putative) (UBE2W), transcript variant 1, mRNA [NM_001001481] |
| 408 | A_23_P72117 | SMPDL3A | TTTTGTGGGAATTTTAGATAAATCTTTGTTAATTACTGAGTGAGTCGGCAAGTAGACTTCCGTC | SEQ ID NO: 1989 | Homo sapiens sphingomyelin phosphodiesterase, acid-like 3A (SMPDL3A), mRNA [NM_006714] |
| 409 | A_23_P7221 | RPL34 | CGAAGGAGCAGAAAAATCGTTGTGAAAGTGTTGAAAGGCACAAGGAGAGAGTCAGAAAGCTAA | SEQ ID NO: 1990 | Homo sapiens ribosomal protein L34 (RPL34), transcript variant 2, mRNA [NM_033625] |
| 410 | A_23_P7229 | RPL34 | CGAAACCCGTGGTAATAGAATTGTTTACCTTTATACCAAGAAGGTTGGGAAAAGGCACAAAA | SEQ ID NO: 1991 | Homo sapiens ribosomal protein L34 (RPL34), transcript variant 2, mRNA [NM_033625] |
| 411 | A_23_P72568 | SNX4 | AAGCCTCAGTAATGAGGCTAAATTTAGTCTGCTTGGCTGTCTGTCACATGGCATTCAGGGCT | SEQ ID NO: 1992 | Homo sapiens sorting nexin 4 (SNX4), mRNA [NM_003794] |
| 412 | A_23_P7262 | MARCH1 | GATTATTGTGTCTTTGCATATTCATGTAAACTCATGTGTGAATGACATTGCAGTGAGC | SEQ ID NO: 1993 | Homo sapiens cDNA FLJ20668 fis, clone KAIA585. [AK000675] |
| 413 | A_23_P7282 | ELMOD2 | TTCAAGTAGCTTTCTCTGGGGGAAAAAAAGTACCACTTGGACACTTAAAGGAATTGGGATTT | SEQ ID NO: 1994 | ELMO domain-containing protein 2. [Source:Uniprot/SWISSPROT;Acc:Q8IZB1] [ENST00000323570] |
| 414 | A_23_P73577 | DYNLT3 | TGTTTCTTTATGCTGGCTTTTGTGCCCTGGAAGATCATAATAGTGACCAAAATATAC | SEQ ID NO: 1995 | Dynein light chain Tctex-type 3 (T-complex-associated testis-expressed 1-like) (Protein 91/23). [Source:Uniprot/SWISSPROT;Acc:P51808] [ENST00000378578] |
| 415 | A_23_P74001 | S100A12 | TGAAGGCTTTTACCGAGCAGCAATGCCTGAATGAGGGTGTCTTTTCTTTCCGCTCACCAAAACC | SEQ ID NO: 1996 | Homo sapiens S100 calcium binding protein A12 (S100A12), mRNA [NM_005621] |
| 416 | A_23_P74799 | SLC25A24 | GATTCTGTATCTTTTGAAAAAAGCCGAGAGTTGAAGATAGTATATTTCTGGCTAGTACTG | SEQ ID NO: 1997 | Homo sapiens solute carrier family 25 (mitochondrial carrier; phosphate carrier), member 24 (SLC25A24), transcript variant 2, mRNA [NM_213651] |
| 417 | A_23_P75028 | REEP3 | AGAAACGACCACAAGTGTATTTTAGTCATCTACACGTCAAATATCCCAAGACAGATTAT | SEQ ID NO: 1998 | Homo sapiens receptor accessory protein 3 (REEP3), mRNA [NM_001001330] |
| 418 | A_23_P7643 | ZFYVE16 | TCTGCCTCAGGCATTATCTCAAATGATCTTGATAGTGGTCTGATACCTGTGATCCATGGTGG | SEQ ID NO: 1999 | Homo sapiens zinc finger, FYVE domain containing 16 (ZFYVE16), mRNA [NM_014733] |

Fig. 5-23

| No. | Probe ID No. | Symbols of genes | Sequence | SEQ ID NO: | Descriptions of genes (letters and numbers within [ ] indicates GenBank accession No.) |
|---|---|---|---|---|---|
| 419 | A_23_P75789 | MS4A4A | CACCAAAAGATCAACAGACAAATGCTCAGAGAAATCTATGCTGACTGTGACACAAGAGCCT | SEQ ID NO: 2000 | Homo sapiens membrane-spanning 4-domains, subfamily A, member 4 (MS4A4A), transcript variant 1, mRNA [NM_024021] |
| 420 | A_23_P76159 | EEA1 | TATTGTGTTTACTAGTTGTGATCATGTAGTTAGTTGTGCCTTAGTTTGTGAGAAAGGTTAGGCTC | SEQ ID NO: 2001 | Homo sapiens early endosome antigen 1 (EEA1), mRNA [NM_003566] |
| 421 | A_23_P76480 | BF213738 | AAATGGAACACAGGACGAATGGGTAGAGCTAGATTTACCAAATCGTTTGGCATGACAGG | SEQ ID NO: 2002 | BF213738 601847628F1 NIH_MGC_55 Homo sapiens cDNA clone IMAGE:4078519 5', mRNA sequence [BF213738] |
| 422 | A_23_P76851 | TXNDC1 | ATTTGTGTAATGTGTCGCCTTCTTCTAGGCTCTGTTGGTGTGTGAATCCATTAGATTTACA | SEQ ID NO: 2003 | Homo sapiens thioredoxin domain containing 1 (TXNDC1), mRNA [NM_030755] |
| 423 | A_23_P78092 | EVI2A | GCTGAATCAGACACTTGGAAAAGAACAAAAGAGCTCACAGGACCCAACCTAGTATGCAA | SEQ ID NO: 2004 | Homo sapiens ecotropic viral integration site 2A (EVI2A), transcript variant 1, mRNA [NM_001003927] |
| 424 | A_23_P79199 | DBI | TGGCTCACCATACGGCTCTAAGAGATTAGGGGCTAAAACGATTACTGACTTTCGTTGAGTA | SEQ ID NO: 2005 | Homo sapiens diazepam binding inhibitor (GABA receptor modulator, acyl-Coenzyme A binding protein) (DBI), transcript variant 1, mRNA [NM_020548] |
| 425 | A_23_P81212 | MRPS18C | ATGGGGTTTATGCCAGTTACATACAAGGATCCTGCATATCTCAAGGACCCTAAAGTTTGT | SEQ ID NO: 2006 | Homo sapiens mitochondrial ribosomal protein S18C (MRPS18C), nuclear gene encoding mitochondrial protein, mRNA [NM_016067] |
| 426 | A_23_P83278 | CHMP5 | CATTGCTCTTTTATTTTTTCCATTAAGAGACTCATTGGTTGGAGAAATGCTTGTTCGTAC | SEQ ID NO: 2007 | Homo sapiens chromatin modifying protein 5 (CHMP5), mRNA [NM_016410] |
| 427 | A_23_P84070 | LARP7 | TGATTTCCTAGAAGGGGATACAGAATGCCATGGCTAGATAAAAACCTTAAGACTCCTGAGGATGCTCA | SEQ ID NO: 2008 | Homo sapiens La ribonucleoprotein domain family, member 7 (LARP7), transcript variant 1, mRNA [NM_016648] |
| 428 | A_23_P8640 | GPR30 | AACAGCTGGGGACAACTGCCGTGATGATGTAAAAAACCTTCCCATAAAATGTAAGAAAAGC | SEQ ID NO: 2009 | Homo sapiens G protein-coupled receptor 30 (GPR30), transcript variant 2, mRNA [NM_001505] |
| 429 | A_23_P86653 | SRGN | AGGAGTTGGGTCAACATGGATTAGAAGAGAGGATTTTATGTTATAAGAGAGGATTTTCCAC | SEQ ID NO: 2010 | Homo sapiens serglycin (SRGN), mRNA [NM_002727] |
| 430 | A_23_P87879 | CD69 | TGTCGCAATATGTGATGTGGCAAATGTCTATTAGGAAATATTCTGTAATGTTCAGACGTAG | SEQ ID NO: 2011 | Homo sapiens CD69 molecule (CD69), mRNA [NM_001781] |
| 431 | A_23_P89145 | ZNF83 | GTATAATGAATGTAGCAGAGACCTTTAGTTTTTGTTCAAGGCTAATAACCGTTAGCTAGA | SEQ ID NO: 2012 | Homo sapiens zinc finger protein 83 (ZNF83), mRNA [NM_018300] |
| 432 | A_23_P9056 | RB1CC1 | TTCATTTTCTCAAAGGGCATACCGTTGTGCATTGTGGCTTATGATGAGCCATATTAATTGC | SEQ ID NO: 2013 | Homo sapiens RB1-inducible coiled-coil 1 (RB1CC1), mRNA [NM_014781] |
| 433 | A_23_P91346 | BC008567 | GGGCTTAGGAGTGAGATTTCTGTCTACAGACAAATGATCATGCTCATGAATTTTGACATTT | SEQ ID NO: 2014 | Homo sapiens cDNA clone MGC:17708 IMAGE:3868595, complete cds. [BC008667] |
| 434 | A_23_P92410 | CASP3 | TGCACCAAGTCTCACTGGCTCTGTCAGTATGACATTTCAGGGAGATTTCTTGTTGCTCAAA | SEQ ID NO: 2015 | Homo sapiens caspase 3, apoptosis-related cysteine peptidase (CASP3), transcript variant alpha, mRNA [NM_004346] |
| 435 | A_23_P92842 | SAR1B | TAATCTGACATCACCCCAGGGCATTTGTAAAGAGCAACTTTCCAGCAGTACATTTGAAG | SEQ ID NO: 2016 | Homo sapiens SAR1 gene homolog B (S. cerevisiae) (SAR1B), transcript variant 2, mRNA [NM_016103] |
| 436 | A_23_P933 | RWDD3 | GGAATCTTTTAGTAAAATAGGACGTGTTTTTGTTGTTTTGCATTGGAATTGGGGAGTGG | SEQ ID NO: 2017 | Homo sapiens RWD domain containing 3 (RWDD3), mRNA [NM_015485] |

Fig. 5-24

| No. | Probe ID No. | Symbols of genes | Sequence | SEQ ID NO: | Descriptions of genes (letters and numbers within [ ] indicates GenBank accession No.) |
|---|---|---|---|---|---|
| 437 | A_23_P94230 | LY96 | TGAAGCTATTTCTGGGAGCCAGAAGAAATGCTGTTTGCTTGGA GTTTGTCATCCTACA | SEQ ID NO: 2018 | Homo sapiens lymphocyte antigen 96 (LY96), mRNA [NM_015364] |
| 438 | A_23_P94501 | ANXA1 | GGCTCTTTGTGGAGGAAACTAAACATTCCCTTGATGGTCTCAAGC TATGATCAGAAGACT | SEQ ID NO: 2019 | Homo sapiens annexin A1 (ANXA1), mRNA [NM_000700] |
| 439 | A_23_P94533 | CTSL1 | AAGACATGGATCATGGTGTCGTCGGTGGTGGGTAGGATTTGAAA GCACAGATCAGATA | SEQ ID NO: 2020 | Homo sapiens cathepsin L1 (CTSL1), transcript variant 1, mRNA [NM_001912] |
| 440 | A_23_P95594 | NAT1 | TCCTTGCAGAGAAAGCTTGTGCCAAACATGGTGATAGATTTTTT ACTATTTAGAATAAG | SEQ ID NO: 2021 | Homo sapiens N-acetyltransferase 1 (arylamine N-acetyltransferase) (NAT1), mRNA [NM_000662] |
| 441 | A_23_P9574 | ECT2 | TAATAGTTAACTGACTACTATAGATTGTTTGTATGCCATGTATGTGC CACTTCTGAGAGTAG | SEQ ID NO: 2022 | Homo sapiens epithelial cell transforming sequence 2 oncogene (ECT2), mRNA [NM_018098] |
| 442 | A_23_P96658 | CYorf15B | ATGCCCTAAAGTAAATACCAGCAGTCATATTTTATCAGATGTAAA TCTGGATGTAAGGTC | SEQ ID NO: 2023 | lipopolysaccharide-specific response 5-like protein [Source:RefSeq_peptide;Acc:NP_115965] [ENST00000392832] |
| 443 | A_23_P98382 | TIMM8B | TTGTTACTAAGCAGATTAAGGGTCAGTGGGGGAAGGCTATCAAC CCATTGTCAGATCAG | SEQ ID NO: 2024 | Homo sapiens translocase of inner mitochondrial membrane 8 homolog B (yeast) (TIMM8B), mRNA [NM_012459] |
| 444 | A_23_P98446 | SC5DL | TGTGAACACCAGGACTTTAATCTTATGCTTAAAATGCCAGAATGTT GTTCGGGGACAACT | SEQ ID NO: 2025 | Homo sapiens sterol-C5-desaturase (ERG3 delta-5-desaturase homolog, S. cerevisiae)-like (SC5DL), transcript variant 2, mRNA [NM_001024956] |
| 445 | A_23_P99980 | HMGB1 | GGATTCTTTCCATTTGGATTTGTTTATGTAATTTCAGGAGGAATA GTGAACATCTGAGTC | SEQ ID NO: 2026 | Homo sapiens high-mobility group box 1 (HMGB1), mRNA [NM_002128] |
| 446 | A_23_P99985 | HMGB1 | TGGGCCAGCTTTTCAAACAAGATGCCACATTCAAAATAAGGGTAT ATTTTGGTATATTAC | SEQ ID NO: 2027 | Homo sapiens high-mobility group box 1 (HMGB1), mRNA [NM_002128] |
| 447 | A_24_P105648 | BX111927 | TTATGAGATGCTTCAGTTCAAATAACAGTGCAGTAATTCACCTAT ATCTAAAAGACTGCC | SEQ ID NO: 2028 | BX111927 Soares multiple sclerosis 2NbHMSP Homo sapiens cDNA clone IMAGp998G05619, mRNA sequence [BX111927] |
| 448 | A_24_P105794 | RPL31 | CAGAGCCGTCTACAAAAGGTTTTACAGTTGAAATATGAAATGTG ATGTGGGTATGGAAA | SEQ ID NO: 2029 | Homo sapiens ribosomal protein L31, mRNA (cDNA clone MGC:88191 IMAGE:4714258), complete cds. [BC070210] |
| 449 | A_24_P105913 | THC2605573 | CTGTGCTCTAGGAAATGCACCAATACCAAAGGTCAATGTGGAAAT ATGGGCATGTTTGCC | SEQ ID NO: 2030 | AY151386 NAP1 [Homo sapiens] {exp=-1; wgp=0; cg=0}, partial (35%) [THC2605573] |
| 450 | A_24_P107257 | LIN7C | TATTAGTGTGGGACTGTGACTGAGGTCTTAAAGACTGAAAGAGTT GGGGTTCATTTTCTG | SEQ ID NO: 2031 | Homo sapiens lin-7 homolog C (C. elegans) (LIN7C), mRNA [NM_018362] |
| 451 | A_24_P11045 | THC2785765 | CCACCAGAAAGCTACAACCTGATTTCATGACAAATACGGTAGCAA GACAAGTCGGAATAG | SEQ ID NO: 2032 | COX7B HUMAN (P24311) Cytochrome c oxidase polypeptide VIIb, mitochondrial precursor, partial (78%) [THC2785765] |
| 452 | A_24_P114249 | GALNT3 | ATTTCAAATGGAGAATACTTGACTCATTTAAAGCTAAATTTTGTT ACTGATTCAATTATA | SEQ ID NO: 2033 | Homo sapiens UDP-N-acetyl-alpha-D-galactosamine:polypeptide N-acetylgalactosaminyltransferase 3 (GalNAc-T3) (GALNT3), mRNA [NM_004482] |
| 453 | A_24_P115774 | BIRC2 | GATACCATTTTGGTTAAAGGAAATGCTGCGGCCAACATCTCAAA AACTGTCTAAAAGAA | SEQ ID NO: 2034 | Homo sapiens baculoviral IAP repeat-containing 2 (BIRC2), mRNA [NM_001166] |

Fig. 5-25

| No. | Probe ID No. | Symbols of genes | Sequence | SEQ ID NO: | Descriptions of genes (letters and numbers within [ ] indicates GenBank accession No.) |
|---|---|---|---|---|---|
| 454 | A_24_P116766 | ZNF207 | TTTCTGAGAGCCAGGTATACGAGTGAAAATTAGCTTCTGAGTAAAT TTCTAATTTATGCCC | SEQ ID NO: 2035 | Homo sapiens mRNA; cDNA DKFZp761N202 (from clone DKFZp761N202), [AL834501] |
| 455 | A_24_P118855 | ENST00000329784 | GCTATGGTGGGCAGAGTAAGCCGATTTTCCAGAAAAAGGCTAAAA CTACAAAGAATACTG | SEQ ID NO: 2036 | PREDICTED: Homo sapiens similar to large subunit ribosomal protein L36a (LOC284230), mRNA [XM_208185] |
| 456 | A_24_P124992 | PSMA4 | AAAGGTCGCTTTGGTGTTGCATTGGTGTACATTGGGTGGATAAG CACTATGGCTTTCAG | SEQ ID NO: 2037 | Homo sapiens proteasome (prosome, macropain) subunit, alpha type, 4 (PSMA4), mRNA [NM_002789] |
| 457 | A_24_P126741 | ENST00000308178 | AGCCTCCAACCACACTAACAAGATTCAAGATTACTTGGAACACGCT CACAGGAGCGAGAAT | SEQ ID NO: 2038 | |
| 458 | A_24_P126890 | RPL9 | GGTGTTGCTTGTCAGTATGTCAAAGCCAGAGAACATGAATTAATC CTTGAAGGAAATGAC | SEQ ID NO: 2039 | Homo sapiens ribosomal protein L9 (RPL9), transcript variant 1, mRNA [NM_000661] |
| 459 | A_24_P127181 | LOC442237 | AACTGAAATCTTTCCAGAAAATCCAAGTCCAGCTAGTAGAATTGG AGAAAAAGTTCAGTG | SEQ ID NO: 2040 | PREDICTED: Homo sapiens similar to 40S ribosomal protein S7 (S8) (LOC442237), mRNA [XR_018963] |
| 460 | A_24_P127621 | A_24_P127621 | TCGAAGCAAGTACCACAAAAGGCATTCAAATGCACTTTCCACAT TCTCAGAAATATTAG | SEQ ID NO: 2041 | |
| 461 | A_24_P132787 | RAB18 | TAAAACGTCACATCTACTTGATTTACACTTCCTAGTGTACATT ACATGTGGTTGAAGG | SEQ ID NO: 2042 | Homo sapiens RAB18, member RAS oncogene family (RAB18), mRNA [NM_021252] |
| 462 | A_24_P133991 | ANKRD12 | TTTGGAATGGAGTATATGCCTGAAAAGGTTTTGGATTCAGAAAGA AAAAGGATGGTTAGT | SEQ ID NO: 2043 | Homo sapiens ankyrin repeat domain 12 (ANKRD12), mRNA [NM_015208] |
| 463 | A_24_P134392 | STCH | TGAGTAACTTATTTTGTATCAGGAATGTGTTTTCGGTACTGTGTTTTC AGTCAAACGACTGAC | SEQ ID NO: 2044 | Homo sapiens stress 70 protein chaperone, microsome-associated, 60kDa (STCH), mRNA [NM_006948] |
| 464 | A_24_P135242 | A_24_P135242 | GATGGCAAGACAAAAGGCTGGGAACTAGTTTGTACCTGCAGAACCGAA ACTGGGCATTGTCAT | SEQ ID NO: 2045 | |
| 465 | A_24_P135551 | LOC130866 | TAACAGCATAGCTGTCGCTGTGGGCATTCACGCAAAGGTGGTTAT CACTGAGACTAAAAGT | SEQ ID NO: 2046 | PREDICTED: Homo sapiens similar to gene 20 protein (SIG-20) (LOC130866), mRNA [XR_019454] |
| 466 | A_24_P139208 | USP25 | GAATATAGACAAGGTGATTATTTCGGTCTTGAGACTCCAAAGTACTT GAATAAGGGCTATTG | SEQ ID NO: 2047 | Homo sapiens ubiquitin specific peptidase 25 (USP25), mRNA [NM_013396] |
| 467 | A_24_P141214 | STOM | GGGTGACATTTGTAACATTTCGTCTTTGAGACTCGTGAGTTCAACGT AGAGAAGTCTAAGCA | SEQ ID NO: 2048 | Homo sapiens stomatin (STOM), transcript variant 2, mRNA [NM_198194] |
| 468 | A_24_P144383 | A_24_P144383 | GTGGCGTTGAGCCCAAAAGATCTAAGAGAATGGTGGCCTAAAAGATG CAAGCATTTGAACT | SEQ ID NO: 2049 | |
| 469 | A_24_P144688 | LOC401975 | TGTTCGATGTCAAGACTAATGATGGGCTAGTTCTTCTTTAATCTGTCTG TGTTGGTTTTACTGA | SEQ ID NO: 2050 | PREDICTED: Homo sapiens similar to ribosomal protein S3a (LOC401975), mRNA [XR_017247] |
| 470 | A_24_P148151 | TSNAX | AAAGTTGAGTTATATAGTTGTACATAGCAATGGAAATGCTTTTAGT AGTGATTATTTAGCA | SEQ ID NO: 2051 | Homo sapiens translin-associated factor X (TSNAX), mRNA [NM_005999] |
| 471 | A_24_P152753 | LOC285260 | TGTCTGATACCGGAATCGGTGCGATTATCCAGAGAAGGATGAAGA TTCACCGAAAATAAGCT | SEQ ID NO: 2052 | PREDICTED: Homo sapiens similar to ribosomal protein L31 (LOC285260), mRNA [XR_019376] |
| 472 | A_24_P152775 | LOC442195 | ACACAAACAAGGTGTGAGGAGATCCCGATTATCCTCAGCAAGA AGCTCCACAACAGGA | SEQ ID NO: 2053 | PREDICTED: Homo sapiens hypothetical LOC442195 (LOC442195), mRNA [XR_019264] |
| 473 | A_24_P153324 | LOC390413 | GAAGCTTAAGCAAGGTTTCAATTAACACTGCTGGGGATTGTAGAACC ATATATTGCAGGGTA | SEQ ID NO: 2054 | PREDICTED: Homo sapiens similar to 60S ribosomal protein L7 (LOC390413), mRNA [XR_018341] |

Fig. 5-26

| No. | Probe ID No. | Symbols of genes | Sequence | SEQ ID NO: | Descriptions of genes (letters and numbers within [ ] indicate GenBank accession No.) |
|---|---|---|---|---|---|
| 474 | A_24_P153511 | OSBPL8 | CCTTGTGCCATATACACAGAAAATTTGTGGAAGGGAGTTTTAACTTTCTGAAGAATATC | SEQ ID NO: 2055 | Homo sapiens oxysterol binding protein-like 8 (OSBPL8), transcript variant 1, mRNA [NM_020841] |
| 475 | A_24_P15755 | AK098635 | TCCAAGTCTGGCTAGTACGTGAATTGGAGAAAAAGTTTGGGAAGCATGTGTCTTATTG | SEQ ID NO: 2056 | Homo sapiens cDNA FLJ25739 fis, clone TST05834. [AK098605] |
| 476 | A_24_P161914 | LOC130728 | CTATACTGTTGGAAACACTTCAAAGAGAAATAACTTCCTGCGGCCATTCAAATTATCTC | SEQ ID NO: 2057 | PREDICTED: Homo sapiens similar to 60S ribosomal protein L7 (LOC130728), mRNA [XR_019248] |
| 477 | A_24_P165595 | ARL5A | GAAGTAACTTGACCCAGAAACACCTTTATGTTTGCTTAGGGTATATTTTTTTCAGTGTCTG | SEQ ID NO: 2058 | Homo sapiens ADP-ribosylation factor-like 5A (ARL5A), transcript variant 1, mRNA [NM_012097] |
| 478 | A_24_P165864 | P2RY14 | TTTTTCTGGAAAACAGACGGATTTTACTTCTTCTGGAGAATGGCATACGGTTACTGACTTAT | SEQ ID NO: 2059 | Homo sapiens purinergic receptor P2Y, G-protein coupled, 14 (P2RY14), transcript variant 2, mRNA [NM_014879] |
| 479 | A_24_P167063 | ZNF518 | AAAGAAAGCGATACATAGAATGCTTCAAGCTATCTTGCTATGCACATTATACTTGTTACTG | SEQ ID NO: 2060 | Homo sapiens zinc finger protein 518 (ZNF518), mRNA [NM_014803] |
| 480 | A_24_P169378 | RPS7 | AACTGAAATCTTCCAGAATTCCAAATCCGGCTAGTAAGTGAATTGGAGAAAAAGTTCA | SEQ ID NO: 2061 | Homo sapiens ribosomal protein S7 (RPS7), mRNA [NM_001011] |
| 481 | A_24_P171873 | FBXO4 | GATTCCACAGATTCAAAAAGTGTGTCAGAATGGTGTAGATGGGTTCATCTATGTTGCAAATGC | SEQ ID NO: 2062 | Homo sapiens F-box protein 4 (FBXO4), transcript variant 1, mRNA [NM_012176] |
| 482 | A_24_P172481 | TRIM22 | TGGCCCTTTAAAAGATTGAAAGAAAGAAACTTGTCAACTCATATCCACGTTATCTAGCAA | SEQ ID NO: 2063 | Homo sapiens tripartite motif-containing 22 (TRIM22), mRNA [NM_006074] |
| 483 | A_24_P175059 | ATG5 | TTGCACAAGAGGCTGGTCTGAATATGATGTTCACATTAAGAGTGTTATTCGTCGGTTC | SEQ ID NO: 2064 | Homo sapiens ATG5 autophagy related 5 homolog (S. cerevisiae) (ATG5), mRNA [NM_004849] |
| 484 | A_24_P175176 | PHTF2 | AGATTGAAGTTAACTTAAGTAGTTGGGAGTTGATTTATTAAGTACAGTATACCTCTCACAG | SEQ ID NO: 2065 | Homo sapiens putative homeodomain transcription factor 2 (PHTF2), mRNA [NM_020432] |
| 485 | A_24_P175187 | SAMD9 | GAACGAGGGATACGTAATGAAAATGTAATTTTGCCCTAATAAAATTATGGATAATGGGCAG | SEQ ID NO: 2066 | Homo sapiens sterile alpha motif domain containing 9 (SAMD9), mRNA [NM_017654] |
| 486 | A_24_P175188 | SAMD9 | TGCCAAGTGTACTGGCAGATTAACATACAACCTATGTTTCTTGAACAAAAAGCAGCGATA | SEQ ID NO: 2067 | Homo sapiens sterile alpha motif domain containing 9 (SAMD9), mRNA [NM_017654] |
| 487 | A_24_P175519 | TXN | AAGTAGAATGTGGATGAGTGTCAGGATGTGTTCTTCAAGAGTGTGAAGTCAAATGCAGGCAA | SEQ ID NO: 2068 | Homo sapiens thioredoxin (TXN), mRNA [NM_003329] |
| 488 | A_24_P175989 | VPS29 | GAGAGGAGACTTGGATGAGAATCTGAATTGATTATCCAGAACAGAGAAAGTTGTGACTGTTGGACA | SEQ ID NO: 2069 | Homo sapiens vacuolar protein sorting 29 homolog (S. cerevisiae) (VPS29), transcript variant 2, mRNA [NM_057180] |
| 489 | A_24_P178802 | ZNF600 | ATAAGATAATTCACACGGAGCAGGAGAAGCATACAAATGTAAGGTTTGTGACGAAGGCTTTTG | SEQ ID NO: 2070 | Homo sapiens zinc finger protein 600 (ZNF600), mRNA [NM_198457] |
| 490 | A_24_P179351 | TPT1 | GAACAGAGACCAGAGAAAGAGTAAAACCTTTATGACAGGGGCTGCAGAACAAATCAAGCAC | SEQ ID NO: 2071 | Homo sapiens tumor protein, translationally-controlled 1 (TPT1), mRNA [NM_003295] |
| 491 | A_24_P183424 | TMEM30A | CAATGTGTATGCACATTCTCTTAGTTAAGGACACCAATTGTTTGGTTGTTTCCTAAG | SEQ ID NO: 2072 | Homo sapiens transmembrane protein 30A (TMEM30A), mRNA [NM_018847] |
| 492 | A_24_P181120 | PFDN5 | CACGGCATGAAACAGGGCGGTCATGGAAATGATGAGTCAGAAGATTCAGCAGCTCACAGCC | SEQ ID NO: 2073 | Homo sapiens prefoldin subunit 5 (PFDN5), transcript variant 1, mRNA [NM_002624] |
| 493 | A_24_P183864 | IMPA1 | TCAGCCTTATCCCTTGGCACGTAAACAGAGTACTAGACTATTGTAGGTTCGTTTGAGCT | SEQ ID NO: 2074 | Homo sapiens inositol(myo)-1(or 4)-monophosphatase 1 (IMPA1), mRNA [NM_005536] |

Fig. 5-27

| No. | Probe ID No. | Symbols of genes | Sequence | SEQ ID NO: | Descriptions of genes (letters and numbers within [ ] indicates GenBank accession No.) |
|---|---|---|---|---|---|
| 494 | A_24_P186944 | LOC389404 | AGGAACCCTGCGGAGGGACTTCAATGACATCGTAGAACTCAGTCTTCTTGGAAAAGAAAAA | SEQ ID NO: 2075 | PREDICTED: Homo sapiens similar to 60S ribosomal protein L9 (LOC389404), mRNA [XR_018133] |
| 495 | A_24_P188800 | MARCH1 | GTCACGGCAAAAGATTTTCAGAAAATGTTCGGATATAATTAGCTCTGTTAAATACCCACAG | SEQ ID NO: 2076 | Homo sapiens membrane-associated ring finger (C3HC4) 1 (MARCH1), mRNA [NM_017923] |
| 496 | A_24_P188878 | RPL34 | TGTTTACGTTTATACGAAGAAGGTTGGGAAGCACGAAAATCGCATGTGGTGTGTGCCC | SEQ ID NO: 2077 | Homo sapiens ribosomal protein L34 (RPL34), transcript variant 2, mRNA [NM_033625] |
| 497 | A_24_P190804 | AP1S2 | GGTGGAAGATCTAAGGAGTCTTCATGTACTTCATTAAAAATAACATGGATTCCATACTG | SEQ ID NO: 2078 | Homo sapiens adaptor-related protein complex 1, sigma 2 subunit (AP1S2), mRNA [NM_003916] |
| 498 | A_24_P191417 | NAB1 | AAGTTCGTTAAGTACTCTTATGTTTCTAGTGTTTCAAGCTTAGTGATAAGGTGGAAGCAC | SEQ ID NO: 2079 | Homo sapiens NGFI-A binding protein 1 (EGR1 binding protein 1) (NAB1), mRNA [NM_005966] |
| 499 | A_24_P191833 | SFRS12 | AAGGACTTAGGAGTATATGGGAGGTTATTGGTTTTTATGTTTTAAGGATACGTTACTTGAG | SEQ ID NO: 2080 | Homo sapiens splicing factor, arginine/serine-rich 12 (SFRS12), transcript variant 2, mRNA [NM_139168] |
| 500 | A_24_P194313 | C21orf66 | ATTTAAATTAACCCTCTCAGTTAATGTGTCCCTGTAAACGATGTGTGCAGTGTAAATTGT | SEQ ID NO: 2081 | Homo sapiens chromosome 21 open reading frame 66 (C21orf66), transcript variant 1, mRNA [NM_016631] |
| 501 | A_24_P199600 | RNF2 | AAACTGCTTAGATTTTGTTGATGAGATTAGATTAGTAGTTGCATTAAATAACTAAATTCC | SEQ ID NO: 2082 | Homo sapiens ring finger protein 2 (RNF2), mRNA [NM_007212] |
| 502 | A_24_P20120 | KIAA1212 | TTGGACAATGAAAATGCCTTAAAAGGAATGCATATGGATAAAGTTGCACTTATAACACCC | SEQ ID NO: 2083 | Homo sapiens KIAA1212 (KIAA1212), mRNA [NM_018084] |
| 503 | A_24_P201353 | C10orf32 | TCCATCTTTTTAAATGACATTACGATGAGTGTTGTCAAACGTAAATATCTTTGTTTGA | SEQ ID NO: 2084 | Homo sapiens chromosome 10 open reading frame 32 (C10orf32), mRNA [NM_144591] |
| 504 | A_24_P201702 | CLEC2B | ATTGGAATTCAGTAAATAGTAAATACGAACTGTCCACTCAACATGCCGACCTAACTAAATTGACA | SEQ ID NO: 2085 | Homo sapiens C-type lectin domain family 2, member B (CLEC2B), mRNA [NM_005127] |
| 505 | A_24_P203103 | SH2D1A | AAGGCTAAGCTTCACTGTAAATAACTGGGAATTCTGGATTGTGTATGGGTGTTGGT | SEQ ID NO: 2086 | Homo sapiens SH2 domain protein 1A, Duncan's disease (lymphoproliferative syndrome) (SH2D1A), mRNA [NM_002351] |
| 506 | A_24_P203827 | LOC730647 | CTTGCTTTCGATGACACTTCCCCTCAAGACCAACACGTTTCTGTTGATATCGAAAAAA | SEQ ID NO: 2087 | PREDICTED: Homo sapiens similar to Histidine triad nucleotide-binding protein 1 (Adenosine 5-monophosphoramidase) (Protein Kinase C inhibitor 1) (Protein kinase C-interacting protein 1) (PKCI-1) (LOC730647), mRNA [XM_001126674] |
| 507 | A_24_P203909 | RPL34 | GAGGGGTTCATGGTGTAAGACTTAAAGTTCTTATGAAATTGTCCAAAACAAAGAAACATG | SEQ ID NO: 2088 | Homo sapiens ribosomal protein L34 (RPL34), transcript variant 2, mRNA [NM_033625] |
| 508 | A_24_P208045 | EDEM3 | TTTAGAGGGGGGTAGAATTAGTAGATATTCCAGCGGTCGTTTTATGCAGAAGGTTCA | SEQ ID NO: 2089 | Homo sapiens ER degradation enhancer, mannosidase alpha-like 3 (EDEM3), mRNA [NM_025191] |
| 509 | A_24_P20996 | BC043173 | CTGGAAAATGTTGATATATGTATATGAATGTGTCTTTATGCTGAAGGGCTCGTGATTGG | SEQ ID NO: 2090 | Homo sapiens cDNA clone IMAGE:5287121. [BC043173] |
| 510 | A_24_P212864 | LOC646161 | ACAGAAGTACAACGTGCGAATCCATGATCCGAAAGAATGATGAAGTTAGGCTTGTACCAGG | SEQ ID NO: 2091 | PREDICTED: Homo sapiens similar to 60S ribosomal protein L26 (LOC646161), mRNA [XR_018048] |
| 511 | A_24_P213354 | LOC731048 | CACGTGCTTAAAAACAGAGAGTAATGCTGAACTTAAGGGTGATTCTCTGGTCATTGAG | SEQ ID NO: 2092 | PREDICTED: Homo sapiens similar to 60S ribosomal protein L17 (L23) (LOC731048), mRNA [XR_015710] |
| 512 | A_24_P213375 | A_24_P213375 | AAATGTGTTCCATGATGAAAATGGACAACAATGATTGTTCATCTGTTCTGTGTGGTT | SEQ ID NO: 2093 | |

Fig. 5-28

| No. | Probe ID No. | Symbols of genes | Sequence | SEQ ID NO: | Descriptions of genes (letters and numbers within [ ] indicates GenBank accession No.) |
|---|---|---|---|---|---|
| 513 | A_24_P213783 | RPL31 | CTTTGGTTACCTATGTACCTGTTACCACTTTCAAAAATCTACAGACAGTCAATGTGGATG | SEQ ID NO: 2094 | Homo sapiens ribosomal protein L31 (RPL31), mRNA [NM_000993] |
| 514 | A_24_P221375 | A_24_P221375 | TACTTTGGTTACCCATGTACCTACCCACTTTCAAAAATCTACAGAGAGTGAATGTGGAGCA | SEQ ID NO: 2095 | |
| 515 | A_24_P222655 | C1QA | GGGTGACCAGGTCTGGGTTGAAAAGACCCCAAAAAGGGTGCATTTACCAGGGCTGA | SEQ ID NO: 2096 | Homo sapiens complement component 1, q subcomponent, A chain (C1QA), mRNA [NM_015991] |
| 516 | A_24_P222911 | SFRS7 | CAGAAATGTCAATGAGAGTAAGTGGTTTGTAAATCTCAGGTATATTAGGAACACTCC | SEQ ID NO: 2097 | Homo sapiens splicing factor, arginine/serine-rich 7, 35kDa (SFRS7), mRNA [NM_001031684] |
| 517 | A_24_P225308 | ARID4B | GTTGAAAATGGTTTCAAGTTATCAAATTTGTACAAGGACTGTAAAGATTTGTTGACAGCA | SEQ ID NO: 2098 | Homo sapiens AT rich interactive domain 4B (RBP1-like) (ARID4B), transcript variant 1, mRNA [NM_016374] |
| 518 | A_24_P225468 | ANP32E | TCATCTTACTGTGCAATCAAAATTAGAGTACTTTGGTTTGAAAAGAACACTTAGAGCGTC | SEQ ID NO: 2099 | Homo sapiens acidic (leucine-rich) nuclear phosphoprotein 32 family, member E (ANP32E), mRNA [NM_030920] |
| 519 | A_24_P225719 | PREI3 | GACTATTTCTTAGTGAATATTTATACTAAGGTAGTGACTGAGATTTGGTGATCTGGCTG | SEQ ID NO: 2100 | Homo sapiens preimplantation protein 3 (PREI3), transcript variant 1, mRNA [NM_015387] |
| 520 | A_24_P229066 | ENST00000078131 | AAGAAGGTCCACAACAAGACAGCAGGTTATGTCACCCATCTGATGAAGCAGAGTTCAGAGA | SEQ ID NO: 2101 | OTTHUMP00000016594. [Source:Uniprot/SPTREMBL:Acc:Q9NU98] [ENST00000078131] |
| 521 | A_24_P232856 | RPL9 | GAACCGTCCGGAGGGACTTCAATCACGATGCAATGTAGAACTCAGCCTTCTTGAAAGAAA | SEQ ID NO: 2102 | Homo sapiens ribosomal protein L9 (RPL9), transcript variant 1, mRNA [NM_000661] |
| 522 | A_24_P235429 | ABCA1 | CCAAAGAGGCATGTGTCATGTAATACTGAACCACTTTGATATTGAGACATTAATTTGTAC | SEQ ID NO: 2103 | Homo sapiens ATP-binding cassette, sub-family A (ABC1), member 1 (ABCA1), mRNA [NM_005502] |
| 523 | A_24_P236008 | SCYL2 | ATAGACTATGTACTTGTCTGTCGTTTTTGTTTTATTTTGGAATGCTTATAAGCTCG | SEQ ID NO: 2104 | Homo sapiens mRNA for KIAA1360 protein, partial cds. [AB037781] |
| 524 | A_24_P237511 | EIF1AY | GTTTCAGTTACTTAGATGTGTCTCATAAGGTTCTGATACAATTTAAGACAGAAATCTGC | SEQ ID NO: 2105 | Homo sapiens eukaryotic translation initiation factor 1A, Y-linked (EIF1AY), mRNA [NM_004681] |
| 525 | A_24_P242299 | ZRANB2 | GACTTTTGAAAGTCTACCTTCTAAATTGCCCGACGATCTAGATTCTACATGTTACGAT | SEQ ID NO: 2106 | Homo sapiens zinc finger, RAN-binding domain containing 2 (ZRANB2), transcript variant 2, mRNA [NM_005455] |
| 526 | A_24_P25326 | ZMYM6 | AGGACTATTTAAATCAGTGTGTCGTGTAACTCAGTGTTTGGATAAATGCAAAGCAAGTTACCC | SEQ ID NO: 2107 | Homo sapiens zinc finger, MYM-type 6 (ZMYM6), mRNA [NM_007167] |
| 527 | A_24_P255252 | A_24_P255252 | TGGACTACTGGAAGGATGGTGTGTGACTGCATATGTGTATTTCTTTGAGATGATTTAGAAA | SEQ ID NO: 2108 | |
| 528 | A_24_P263524 | TXNDC9 | TGACTTCACCACAGAAACTTAGAATGGGGCTCAGTTGTTCTGACATTGTTAATTACAG | SEQ ID NO: 2109 | Homo sapiens thioredoxin domain containing 9 (TXNDC9), mRNA [NM_005783] |
| 529 | A_24_P264549 | A_24_P264549 | ATTCATAGTACATAGCACATACAGAACATGATCAAAGGTGTTACACTGGACTTGCATTAGAATATG | SEQ ID NO: 2110 | |
| 530 | A_24_P265856 | SENP7 | TTGTGTGTTGGGGGGTACTTTTAAAGGTGACTATTGTTTTGTACATCTAATTTTGGGA | SEQ ID NO: 2111 | Homo sapiens SUMO1/sentrin specific peptidase 7 (SENP7), transcript variant 1, mRNA [NM_020654] |
| 531 | A_24_P268786 | MYNN | TGCAGGAGGATCATACTTTGAGTGAACAGGATTCCATAGAAAAAAGTCCTTTATCAGAAAC | SEQ ID NO: 2112 | Homo sapiens myoneurin (MYNN), mRNA [NM_018657] |

Fig. 5-29

| No. | Probe ID No. | Symbols of genes | Sequence | SEQ ID NO: | Descriptions of genes (letters and numbers within [ ] indicates GenBank accession No.) |
|---|---|---|---|---|---|
| 532 | A_24_P268917 | RAB33B | CCCAGAATCTAATGTAGTTCGTATTAATAACAATGCATTATTGAAAGTATATTGCAAAT | SEQ ID NO: 2113 | Homo sapiens RAB33B, member RAS oncogene family (RAB33B), mRNA [NM_031296] |
| 533 | A_24_P276583 | TMCO1 | CCTTCATTTTCCTGTATATTCTCTGTACTATGTCCATTCGACAGAACATTCAGAAGATTC | SEQ ID NO: 2114 | Homo sapiens transmembrane and coiled-coil domains 1 (TMCO1), mRNA [NM_019026] |
| 534 | A_24_P278008 | DCTN6 | CTATGAAAGGAAGCTCAACTCGAGTAAAGAACTAAGAACAGTGTATAACGTGAAGATAAC | SEQ ID NO: 2115 | Homo sapiens dynactin 6 (DCTN6), mRNA [NM_006571] |
| 535 | A_24_P278460 | MLSTD2 | ACCCATGGAAGAATATAGCTTAGGATTACAAGGAAGCAAGTCCTTACTTACACTGTCTGTCTG | SEQ ID NO: 2116 | Homo sapiens male sterility domain containing 2 (MLSTD2), mRNA [NM_032228] |
| 536 | A_24_P280897 | LOC388532 | AGCACTCTGAGAGCTGGGATAGCTTCCTGAAATACATGAAGGAAAATGACAGAAAAAGA | SEQ ID NO: 2117 | PREDICTED: Homo sapiens similar to ribosomal protein L21 (LOC388532), mRNA [XM_001127035] |
| 537 | A_24_P281304 | A_24_P281304 | GAGGAGAAGGCACCGGATATATGGTGTCTAAGCGTTTTAGAAAACAAGTTTTTCCTTTGGC | SEQ ID NO: 2118 | |
| 538 | A_24_P285179 | THC2649313 | AGTGGGAATTTTGAAATGCCATGTCCTATATATTCTGGCATATTGTTGGCACATTTGCA | SEQ ID NO: 2119 | |
| 539 | A_24_P286054 | ZFYVE16 | GTGTATGTATTCTGCCATGTAAGTAATTGAACAGAGTCTTAAAATAACCAAATGGTAGAGGG | SEQ ID NO: 2120 | Zinc finger FYVE domain-containing protein 16 (Endofin) (Endosome-associated FYVE domain protein). [Source:Uniprot/SWISSPROT:Acc:Q7Z3T8] [ENST00000380248] |
| 540 | A_24_P287756 | NUDT21 | CCCGATACTTACTTCACTTGTTATACATGACTGATTATTTGGGTTAAACTGCAGTCATTTC | SEQ ID NO: 2121 | Homo sapiens nudix (nucleoside diphosphate linked moiety X)-type motif 21 (NUDT21), mRNA [NM_007006] |
| 541 | A_24_P29001 | LSM3 | CCGTCCACTGAGAGTTGGCTGAAGAGTGTTGTCCTGTATGGAAAACGGGAGAGCTTT | SEQ ID NO: 2122 | Homo sapiens LSM3 homolog, U6 small nuclear RNA associated (S. cerevisiae) (LSM3), mRNA [NM_014463] |
| 542 | A_24_P290257 | A_24_P290257 | CCAATTCATTCAACATAGAACAAGGCAATTATACCATCCAGTCATTGAAGCACACGAAGA | SEQ ID NO: 2123 | |
| 543 | A_24_P295543 | BLOC1S2 | GTTTATTTCTATGTGAGTCACATTGACATCGGATCAGTTTGGGAAATGTGAAAACA | SEQ ID NO: 2124 | Homo sapiens biogenesis of lysosome-related organelles complex-1, subunit 2 (BLOC1S2), transcript variant 2, mRNA [NM_001013421] |
| 544 | A_24_P298238 | A_24_P298238 | ATCGTTGAAGGAAATGACATTGAGCGTTGTTCAATTCAGCAAGCCGATAACAGTTAAAAAC | SEQ ID NO: 2125 | |
| 545 | A_24_P298604 | LOC731599 | GATGGAAATCATGACCAGAGGTGCGGCAAATGACTTGAAAGAATTGGTCAATAAAATGAT | SEQ ID NO: 2126 | PREDICTED: Homo sapiens hypothetical protein LOC731599 (LOC731599), mRNA [XR_015536] |
| 546 | A_24_P30194 | IFIT5 | AATGTGGCTTCTCTAATGTAGTTTCTTTGATTACCGACTACAAGATTATGTACCATCACA | SEQ ID NO: 2127 | Homo sapiens interferon-induced protein with tetratricopeptide repeats 5 (IFIT5), mRNA [NM_012420] |
| 547 | A_24_P303118 | RPL34 | CGAGGAGGAGAAAATCGTTGTGAAAGTGTTGAAGGCACAAAGGACACAGAGTCAGAAAGCTAA | SEQ ID NO: 2128 | Homo sapiens ribosomal protein L34 (RPL34), transcript variant 2, mRNA [NM_033625] |
| 548 | A_24_P303127 | C5orf29 | CCCAAATGCCTAGAACATCACATAAGGCACTAAATGCCTCATGTTTACTGACGGGAATT | SEQ ID NO: 2129 | Homo sapiens chromosome 5 open reading frame 29 (C5orf29), mRNA [NM_152687] |
| 549 | A_24_P305570 | RIN2 | TATGCAGTGAGTTTGGCAAAATCTATTCATTCGTGTGATTTGCTTGTAGAAACAATTTTG | SEQ ID NO: 2130 | Homo sapiens Ras and Rab interactor 2 (RIN2), mRNA [NM_018993] |
| 550 | A_24_P306469 | LOC257039 | AGAGAAACAGAGAACAATTATGTTCCGGAGATCTCAGTCCTCGGATCAGGAGAACCGTTGAA | SEQ ID NO: 2131 | PREDICTED: Homo sapiens similar to 40S ribosomal protein S17 (LOC257039), mRNA [XM_172230] |

Fig. 5-30

| No. | Probe ID No. | Symbols of genes | Sequence | SEQ ID NO: | Descriptions of genes (letters and numbers within [ ] indicates GenBank accession No.) |
|---|---|---|---|---|---|
| 551 | A_24_P306527 | ENST00000308869 | ACCGGATCCGTGCGTGGTTGGTTATCCAGAAAATGTAATGAGGATGAAGATTCACGAAATAAGT | SEQ ID NO: 2132 | PREDICTED: Homo sapiens similar to ribosomal protein L3l (LOC729005), mRNA [XM_001133428] |
| 552 | A_24_P306726 | TPT1 | GACCAGAAACAGTAAAACCTTTTATGACAGGGCTGCAAAACAAATCAAGGACATGCTTG | SEQ ID NO: 2133 | Homo sapiens tumor protein, translationally-controlled 1 (TPT1), mRNA [NM_003295] |
| 553 | A_24_P310894 | CAPZA1 | TGTATTATTTGTCCTTCATACTATCCATCCATACCACACTATCTTCTGTATCAAGGTAGTC | SEQ ID NO: 2134 | Homo sapiens capping protein (actin filament) muscle Z-line, alpha 1 (CAPZA1), mRNA [NM_006135] |
| 554 | A_24_P312417 | ZBTB26 | AGAGGAGGAAGATTTTTAAAACCTTTATCATTCAGGCATTTGTATTTTATGGATCCCAGAGG | SEQ ID NO: 2135 | Zinc finger and BTB domain-containing protein 26 (Zinc finger protein 481) (Zinc finger protein Bioref). [Source:Uniprot/SWISSPROT:Acc:Q9HCK0] [ENST00000373656] |
| 555 | A_24_P315326 | LOC341412 | AAGCTCTATACTTTGGTTACCAATGTACCCGTTACCGCTTTCAAAAATCTACAAGGGCAATG | SEQ ID NO: 2136 | AGENCOURT_10640955 NIH_MGC_126 Homo sapiens cDNA clone IMAGE:6723668 5', mRNA sequence [CA455253] |
| 556 | A_24_P316074 | LOC730902 | TATCAATGGTCGTGAGCCCAAAGGTCAAAGGTCAGCGTTGCAGCTTCCTCCCTTGGTCAAATCTT | SEQ ID NO: 2137 | PREDICTED: Homo sapiens similar to 60S ribosomal protein L7 (LOC730902), mRNA [XR_015600] |
| 557 | A_24_P320328 | SUB1 | CAGAAAAACCTGTAAAGAAAACAGAGGTGAGACTTGAGAGAGCCCTGTCATCCTCTA | SEQ ID NO: 2138 | Homo sapiens SUB1 homolog (S. cerevisiae) (SUB1), mRNA [NM_006713] |
| 558 | A_24_P321511 | GOLT1B | TTAGAGCAAGAATAGTATCTGCTAATGTGTAAGGGACATCGTATTAAGTCCTTGTAGAC | SEQ ID NO: 2139 | Homo sapiens golgi transport 1 homolog B (S. cerevisiae) (GOLT1B), mRNA [NM_016072] |
| 559 | A_24_P324224 | A_24_P324224 | AAAGCTGTCTGGGCGCAAAGGAATAATTGCAAATACAAGTAATGGCTATTTCGTCGGTTGTCCAGAAAA | SEQ ID NO: 2140 | |
| 560 | A_24_P324506 | A_24_P324506 | GGAATATAAGGCAGGTAATTGCAAATACAAGTAATGGCTATTTCGTGTGGACATGCTGTGT | SEQ ID NO: 2141 | |
| 561 | A_24_P32790 | YOD1 | CTAGGGATCTAATTAAGGACATTAAAGTACCAATTCGTGAGCTACTAACCATCAGCTCTTC | SEQ ID NO: 2142 | Homo sapiens YOD1 OTU deubiquinating enzyme 1 homolog (S. cerevisiae) (YOD1), mRNA [NM_018566] |
| 562 | A_24_P33213 | A_24_P33213 | GACCATATATTACATGGGGGTACCCAAATCTGAAGTCAGTAAATGAACTTACTACAAGG | SEQ ID NO: 2143 | |
| 563 | A_24_P333112 | A_24_P333112 | GGTCATCAGAATCAGAAGTCAATGTGTGAGCCCACAGCCAAAAGTATTGCAACTT | SEQ ID NO: 2144 | |
| 564 | A_24_P33607 | LOC652558 | TAAGAAAATAATTGCTTGCTTGAGACGACAACGCTTTGATTGCTCGATCTCTTGGTAATATGG | SEQ ID NO: 2145 | PREDICTED: Homo sapiens similar to 60S ribosomal protein L7 (LOC652558), mRNA [XR_019386] |
| 565 | A_24_P339869 | ZNF295 | TCATATGCCTTAGCAGTAAGTCATTTTTCCATTTTACTTACTTAGGAATAAGGCTTTTTCGAA | SEQ ID NO: 2146 | Homo sapiens zinc finger protein 295 (ZNF295), mRNA [NM_020727] |
| 566 | A_24_P349636 | LOC388401 | AGTTGCTTGCACAGATAACACTTTGATTGCTCGATCTCTTGGTAATATAGCATCAACTG | SEQ ID NO: 2147 | PREDICTED: Homo sapiens similar to 60S ribosomal protein L7 (LOC388401), mRNA [XR_018879] |
| 567 | A_24_P351435 | CRBN | GAAAGTGAAAGCAATTGGAAGACAAAAGGTCAAAGTCGTTGAGCTAAGAGACAGTCAGA | SEQ ID NO: 2148 | Homo sapiens cereblon (CRBN), mRNA [NM_016302] |
| 568 | A_24_P352445 | MRPL42 | TTTTTAGTCATCACAATGACAAAAGGGGTGGTTTTCTTTCACCCAAGAAATGTGGTTTCC | SEQ ID NO: 2149 | Homo sapiens mitochondrial ribosomal protein L42 (MRPL42), nuclear gene encoding mitochondrial protein, transcript variant 3, mRNA [NM_172178] |
| 569 | A_24_P354412 | AK091335 | TGTAGACTGAAGGAGTCTTTGAAAAACACCCAGCATTAAATCTCACTCTGCCGCTGTCT | SEQ ID NO: 2150 | Homo sapiens cDNA FLJ34016 fis, clone FCBBF2002541. [AK091335] |
| 570 | A_24_P354954 | CCDC126 | AATGGAACTGTTGAGGACTTTAGCCAGGTCTATATAATAAAGGTACTTTGTGTCTGCATT | SEQ ID NO: 2151 | Homo sapiens coiled-coil domain containing 126 (CCDC126), mRNA [NM_138771] |

Fig. 5-31

| No. | Probe ID No. | Symbols of genes | Sequence | SEQ ID NO: | Descriptions of genes (letters and numbers within [ ] indicate GenBank accession No.) |
|---|---|---|---|---|---|
| 571 | A_24_P357518 | RPL21 | GGGCACATATATGCTAATCTATAAGAAGGTGATATTGCAGACATCAAGGGAAGGGGTAC | SEQ ID NO: 2152 | Homo sapiens ribosomal protein L21 (RPL21), mRNA [NM_000982] |
| 572 | A_24_P358205 | A_24_P358205 | TGTTCAAAAAGAATGCCCAAGTGTTACCATGGCTAAATGAAAGAGTCTGCAGTGTTC | SEQ ID NO: 2153 | |
| 573 | A_24_P362646 | TXNDC9 | CTCCACATCAGGTGTAAAATACTAGAACAGACATCTGGCAATATTGTCCAAGAAACACCT | SEQ ID NO: 2154 | Homo sapiens thioredoxin domain containing 9 (TXNDC9), mRNA [NM_005783] |
| 574 | A_24_P364025 | UBE2D1 | ATGTGATGGGTGTAGTCATTAGGAAAAGGATTTAAATCACTTGAGTATTTTGTCATGGTTC | SEQ ID NO: 2155 | Homo sapiens ubiquitin-conjugating enzyme E2D 1 (UBC4/5 homolog, yeast) (UBE2D1), mRNA [NM_003338] |
| 575 | A_24_P364807 | AYTL1 | TGTAAGTCTTGTTTCTAGGTAATGCTTCTCTCTGAACAAACTGCTCAAGGGTCTGTGTAA | SEQ ID NO: 2156 | Homo sapiens mRNA; cDNA DKFZp686H22112 (from clone DKFZp686H22112). [BX641069] |
| 576 | A_24_P366165 | LOC391126 | ACTTCCAACCAAATCAAAAATAGCAAAAATAGGCATTTGAATGCACGTTCCCACATTCAGAGG | SEQ ID NO: 2157 | PREDICTED: Homo sapiens similar to 60S ribosomal protein L26 (Silica-induced gene 20 protein) (SIG-20) (LOC391126), mRNA [XR_019504] |
| 577 | A_24_P366546 | RPL31P10 | CGGCTGTGTCAGAAAACGTAATGAGGATGAAGATTCAAATAAGCTCTATACTTTGGTTACC | SEQ ID NO: 2158 | PREDICTED: Homo sapiens similar to ribosomal protein L31 (LOC390283), mRNA [XR_018695] |
| 578 | A_24_P367139 | A_24_P367139 | ACACCATGAAAGTCGCTCAGGCCATGAAGGGTATACATAAAAGCCAAGAAGTATGTGAAAG | SEQ ID NO: 2159 | |
| 579 | A_24_P367191 | LOC652890 | AGTTAAGATCCTGAGGACTGTAGAGCCATATATTGCCTGCTGTGGGTACCCAAATCTGAAGTC | SEQ ID NO: 2160 | PREDICTED: Homo sapiens similar to 60S ribosomal protein L7 (LOC652890), mRNA [XR_019544] |
| 580 | A_24_P367199 | A_24_P367199 | TCTTATGCTCAGCACCAACAGTCTGCCAAATCCAAGAAGAAGGTGTAATCATGACCTGAGA | SEQ ID NO: 2161 | |
| 581 | A_24_P367369 | A_24_P367369 | ATTTAAAGGTTTCGATGTAGATTCTCTGGTGGATGAGGATATCCAAGTGAAGAAGACATCTAA | SEQ ID NO: 2162 | |
| 582 | A_24_P368575 | SLC4A7 | TTTTTAATGAGATTTTGCACACTGATTAGTTTTTGTGTTGTGGCTTTGTTTGGTTTAT | SEQ ID NO: 2163 | Homo sapiens solute carrier family 4, sodium bicarbonate cotransporter, member 7 (SLC4A7), mRNA [NM_003615] |
| 583 | A_24_P370096 | ZNF230 | GAAAGCTTATATTTGTGAGAAATGTGGGAGGGCCTTCATTCACGATTTAAACTTCAGAA | SEQ ID NO: 2164 | Homo sapiens zinc finger protein 230 (ZNF230), mRNA [NM_006300] |
| 584 | A_24_P371053 | ORMDL1 | GAATGAAAGAGTACAGACCAAGTTAAACATCAATTGGTGTCAGTAAACTGACTTTGG | SEQ ID NO: 2165 | Homo sapiens ORM1-like 1 (S. cerevisiae) (ORMDL1), mRNA [NM_016467] |
| 585 | A_24_P371303 | C3orf63 | GTCAGTGTCAAGAAAATGAGAATTAGTTCTTATCTGGTTATACTGAAAGCTGGATAGAG | SEQ ID NO: 2166 | Homo sapiens chromosome 3 open reading frame 63 (C3orf63), mRNA [NM_015224] |
| 586 | A_24_P371399 | C3orf58 | TAAAATAGTTGCATTCGGTTAATTTTTACACATTAGTGCATTGCGTATACAAGTCGGCGC | SEQ ID NO: 2167 | Homo sapiens chromosome 3 open reading frame 58 (C3orf58), mRNA [NM_173552] |
| 587 | A_24_P374319 | RAP2C | ATTGTGTGTTGATGTTCAAATAAAGTGGTATGTGACATTCATGTGATTTATGGGTCAAGCATG | SEQ ID NO: 2168 | Homo sapiens RAP2C, member of RAS oncogene family (RAP2C), mRNA [NM_021183] |
| 588 | A_24_P375599 | LOC731681 | TGTATGCTGACTTCCCGCACATCAAGTCGTTATCCAGAATGGGGTCTGTTGAAATCCGAA | SEQ ID NO: 2169 | PREDICTED: Homo sapiens similar to 60S ribosomal protein L9 (LOC731681), mRNA [XR_019944] |
| 589 | A_24_P375849 | ENST00000359659 | AAGAAAGCTCTGCAACAAGATAGGAGGCTATGTCACACATCTGATGAAGCGGATTCAGAGA | SEQ ID NO: 2170 | Q8BT90_MOUSE (Q8BT90) 10, 11 days embryo whole body cDNA, RIKEN full-length enriched library, clone:2810021H19 product:ribosomal protein S17, full insert sequence. (Fragment), partial (98%) [THC2559910] |

Fig. 5-32

| No. | Probe ID No. | Symbols of genes | Sequence | SEQ ID NO: | Descriptions of genes [letters and numbers within [ ] indicates GenBank accession No.] |
|---|---|---|---|---|---|
| 590 | A_24_P375932 | A_24_P375932 | ATGGTTAAAAATGGAGAGAGCAATGCAGAAGTTAAGGGTTTAGATGTAGAATTGTCTAGTC | SEQ ID NO: 2171 | |
| 591 | A_24_P379379 | CAPZA1 | ACCAGTTTCAGCCTAAAACTCTGGAATGGTCGTTGGAGATCAGAGTGGAAGTTCACCA | SEQ ID NO: 2172 | Homo sapiens capping protein (actin filament) muscle Z-line, alpha 1 (CAPZA1), mRNA [NM_006135] |
| 592 | A_24_P381625 | PSMC6 | ATGAAAGCAGTCAGAAAAGTGGCTGATTCTAAGAACCTGGAGTCTAAATTGGACTACAAA | SEQ ID NO: 2173 | Homo sapiens proteasome (prosome, macropain) 26S subunit, ATPase, 6 (PSMC6), mRNA [NM_002806] |
| 593 | A_24_P383569 | LOC391130 | ATGGATCTGGTGGAGTGGGATTCAGAGGGGGTAAGATACCAGTAAGAGGTATCCATCAAG | SEQ ID NO: 2174 | PREDICTED: Homo sapiens similar to 40S ribosomal protein S17 (LOC391130), mRNA [XR_019508] |
| 594 | A_24_P383998 | RPS3A | TGGTTTTTACTAAAAAACGCAACAATCAGATACAGAGAGACCTCTATGCCCAGCACCAACG | SEQ ID NO: 2175 | Homo sapiens ribosomal protein S3A (RPS3A), mRNA [NM_001006] |
| 595 | A_24_P384411 | A_24_P384411 | ATGGCAAAATCAATAAGAGTGAAGGTTTGACAGATAATGCTTGACAGTCGATGTCTTG | SEQ ID NO: 2176 | |
| 596 | A_24_P384639 | LOC730452 | CAAGAAAAGCTGGCAACTTTCTATGTACCGACAGAACCCAAATTGGCATTTGCATCAGGA | SEQ ID NO: 2177 | PREDICTED: Homo sapiens similar to 60S ribosomal protein L7 (LOC730452), mRNA [XM_001125895] |
| 597 | A_24_P387869 | PKN2 | TTGTCAGAGATCATTTATATTACCTCCAAATTGTTTATTACCCAAGATCCTTTGGGAG | SEQ ID NO: 2178 | Homo sapiens protein kinase N2 (PKN2), mRNA [NM_006256] |
| 598 | A_24_P392231 | LOC641784 | CCATCAATATTCAGAAGTGCATCCATGATGGGCAAGAAGCGTGCCCCTCGGGAACTCA | SEQ ID NO: 2179 | xr55h07.x1 NCI_CGAP_Ov26 Homo sapiens cDNA clone IMAGE:2764093 3' similar to gb:X69181 60S RIBOSOMAL PROTEIN L31 (HUMAN);, mRNA sequence [AW302767] |
| 599 | A_24_P392900 | A_24_P392900 | GTCTGTTCTGTGTTGGTTTCTAAAAACAATGTAACAATCGGAAAAACCTTTTATGGTC | SEQ ID NO: 2180 | |
| 600 | A_24_P39378 | CCPG1 | TACTTTTTGTCGCTGGAACGAACTGATCAGTTGATCAATAAGTTTTTCCTAAAGCGTGT | SEQ ID NO: 2181 | Homo sapiens cell cycle progression 1 (CCPG1), transcript variant 1, mRNA [NM_004748] |
| 601 | A_24_P393811 | TMCC1 | AGATGACACCAGAGTGTTCCTTCATTTCTGTATATGTCTGTACTATGTGATTGGAG | SEQ ID NO: 2182 | Homo sapiens transmembrane and coiled-coil domains 1 (TMCC1), mRNA [NM_019026] |
| 602 | A_24_P399942 | ATP11C | TGACGATGTTACCTACTAAACTGAAAACATTCATTCCATATCTACTACAGACAGAG | SEQ ID NO: 2183 | Homo sapiens ATPase, Class VI, type 11C (ATP11C), transcript variant 1, mRNA [NM_173694] |
| 603 | A_24_P40417 | FMR1 | TTGTGAGTTTGTTTTCTTTCATTTGAATTTCATTTACAGTTACTTTCCTTGGCATACAACAAG | SEQ ID NO: 2184 | Homo sapiens fragile X mental retardation 1 (FMR1), mRNA [NM_002024] |
| 604 | A_24_P405002 | PDIK1L | TGGTGCTAAGGGATACTTTGTCATTATGATGAACTAAGTGTTAAGTGTCAGATAAATAGC | SEQ ID NO: 2185 | Homo sapiens PDLIM1 interacting kinase 1 like (PDIK1L), mRNA [NM_152835] |
| 605 | A_24_P405298 | PPP1CB | GTATTAGGTTAGGTCACAAAGGTTTTATCTGAGGTGATTTAAATAACTTCCTGATTGGAG | SEQ ID NO: 2186 | Homo sapiens protein phosphatase 1, catalytic subunit, beta isoform (PPP1CB), transcript variant 1, mRNA [NM_002709] |
| 606 | A_24_P405430 | TIA1 | GGATTTTCTCTGTGTTAAATCACAAAATGATAGTCCCAATACGTTTCTTTATAGGAGG | SEQ ID NO: 2187 | Homo sapiens cDNA FLJ36425 fis, clone THYMU2011482. [AK093744] |
| 607 | A_24_P406034 | SLC35A1 | ATGTACAGTATTTTGTCCTAGCAGGATAAAGACCTAGCTGTCTTTCTTACAAGAGCAGAA | SEQ ID NO: 2188 | Homo sapiens solute carrier family 35 (CMP-sialic acid transporter), member A1 (SLC35A1), mRNA [NM_006416] |
| 608 | A_24_P409681 | A_24_P409681 | ACATGAGGCTCCCCTGCCGCTGGAGATGATTCTTGAAAAGGAACAGATTGTTCATAAAC | SEQ ID NO: 2189 | |

Fig. 5-33

| No. | Probe ID No. | Symbols of genes | Sequence | SEQ ID NO: | Descriptions of genes (letters and numbers within [ ] indicates GenBank accession No.) |
|---|---|---|---|---|---|
| 609 | A_24_P414256 | CCDC72 | TCTTTGGTTGCTTGTTCTGACCCTAAAGTTTGTATCACCTGAAATTAAACGAACTCATTTGA | SEQ ID NO: 2190 | Homo sapiens HSPC330 mRNA, partial cds. [AF161448] |
| 610 | A_24_P414556 | TTC33 | TACTGAACATTTGGTATATTGTTTTGAGTAATGACATGATCTTTGTTTTTGTGTAATTTGTGA | SEQ ID NO: 2191 | Homo sapiens tetratricopeptide repeat domain 33 (TTC33), mRNA [NM_012382] |
| 611 | A_24_P414952 | TMEM168 | TTTTCTACTGACGGTCAAGAGTCAGAGGATAGGAAAGAAGTATTCTCTTCTGGTATACATGTAATG | SEQ ID NO: 2192 | Homo sapiens transmembrane protein 168 (TMEM168), mRNA [NM_022484] |
| 612 | A_24_P41551 | LOC641790 | AAGGAGATGGGAACTCCTGATGTGGCATTGATATCAGGCACAACAAAGTAGTCTGGAAA | SEQ ID NO: 2193 | PREDICTED: Homo sapiens similar to ribosomal protein L31 (LOC641790), mRNA [XR_018025] |
| 613 | A_24_P417281 | TXNDC10 | ATGATGAGTGATTGCTTGGGAAGATAAATGTTAATGTTCCGAATAGTCAAGCTGTTTTGC | SEQ ID NO: 2194 | Homo sapiens thioredoxin domain containing 10 (TXNDC10), mRNA [NM_019022] |
| 614 | A_24_P418418 | RPS17 | GATGAACTTCAAAATGCCTCGGGGGACCTGTTTGAATTTTTTCTGCAGTGCTGTATTATT | SEQ ID NO: 2195 | Homo sapiens ribosomal protein S17 (RPS17), mRNA [NM_001021] |
| 615 | A_24_P418712 | A_24_P418712 | AGGCTCAACAAAGCTGTCTGGGCCAAAGAAATAAGGAATATCGATACCATATCGTGTTA | SEQ ID NO: 2196 | |
| 616 | A_24_P487736 | CXorf23 | TGCATACCTACTATCTGTGAAGAGCAAATGGATGGATTTTAAATGAAATTTTAGGCCC | SEQ ID NO: 2197 | Homo sapiens chromosome X open reading frame 23 (CXorf23), mRNA [NM_198279] |
| 617 | A_24_P50437 | BC065737 | TGCAGAATGATGAAGTTGCATTAGAAAATTCCTGATTACTGAAGATGTTCAAGGGCAAAA | SEQ ID NO: 2198 | Homo sapiens cDNA clone IMAGE:30404477, partial cds. [BC065737] |
| 618 | A_24_P50472 | LOC649839 | TAAAACTACAAAGAAGATGTGTGCTGGGCTTGAGTGCATTCAGCCCAACTGCAATCGAA | SEQ ID NO: 2199 | PREDICTED: Homo sapiens similar to large subunit ribosomal protein L36a (LOC649839), mRNA [XM_001129410] |
| 619 | A_24_P50554 | LOC391655 | TCAAGGGTTTAAGATGTAGATTCTCTGGTCATTGAGTATAACGGAGTAAACAAAGACCTA | SEQ ID NO: 2200 | PREDICTED: Homo sapiens similar to 60S ribosomal protein L17 (L23) (LOC391655), mRNA [XR_018405] |
| 620 | A_24_P50567 | A_24_P50567 | CCTTGCTAATTTGAAAAAGTACCAGAACAATGAATCAGATGCATGGTTGCTGTGACTA | SEQ ID NO: 2201 | |
| 621 | A_24_P538403 | ROCK1 | TTAGAGGTTTGTTGGACTTTCATAAATTGAGTACAACATGTTTGGATCAAACTACCTGCTAC | SEQ ID NO: 2202 | Homo sapiens Rho-associated, coiled-coil containing protein kinase 1 (ROCK1), mRNA [NM_005406] |
| 622 | A_24_P54178 | TMED5 | GCTCTGATATGCATTTGGATGATTAATGTTATGCTGTTCTTTCATGTGAATGTCAAGAGA | SEQ ID NO: 2203 | Homo sapiens transmembrane emp24 protein transport domain containing 5 (TMED5), mRNA [NM_016040] |
| 623 | A_24_P561223 | THC2697551 | TTATGCCAGTTACATACAAGAGATCCTGCCATATTTCAGGAGACCCTAAAGTTTATAACAT | SEQ ID NO: 2204 | ALU1_HUMAN (P39188) Alu subfamily J sequence contamination warning entry, partial (8%) [THC2697551] |
| 624 | A_24_P56240 | CPNE8 | TACAACTATGTGACTTAGTGCACAACACATTTGTGAAATAACCTACTCCTATATAGTGAG | SEQ ID NO: 2205 | Homo sapiens copine VIII (CPNE8), mRNA [NM_1536341] |
| 625 | A_24_P56252 | AF086032 | GTATCTAAAACTGAAGCAGTACTGTGCTATATTGATTTTATTGGTAGTATTGAGGCAGACC | SEQ ID NO: 2206 | Homo sapiens full length insert cDNA clone YM25609. [AF086032] |
| 626 | A_24_P57837 | THC2567891 | AGAAATCCGGAAGAGACGTCTTATGCTCAGTACGACCCAAATCCGGAAGAAGATGAGGAAA | SEQ ID NO: 2207 | Q6NXR8_HUMAN (Q6NXR8) Ribosomal protein S3a, partial (91%) [THC2567891] |
| 627 | A_24_P587938 | A_24_P587938 | CTTCAAAGAAGCAAAAGGTGGAGATGCTGGGCAACAGCGGAGGACGAGATTAACAGTCTTAT | SEQ ID NO: 2208 | |
| 628 | A_24_P606653 | LOC392030 | TGTGCGGTTGCCCAGAAAACGTAATGCCGGGTGAAGATTCACCAAATAAGGTCCATAGTTT | SEQ ID NO: 2209 | PREDICTED: Homo sapiens hypothetical LOC392030 (LOC392030), mRNA [XR_018063] |

Fig. 5-34

| No. | Probe ID No. | Symbols of genes | Sequence | SEQ ID NO: | Descriptions of genes (letters and numbers within [ ] indicates GenBank accession No.) |
|---|---|---|---|---|---|
| 629 | A_24_P62530 | RHOU | GGGTGAACTACAAGTGTAGGGCACCATTATAATTTATAAATACAG CATACTTCAAAAGTG | SEQ ID NO: 2210 | Homo sapiens ras homolog gene family, member U (RHOU), mRNA [NM_021205] |
| 630 | A_24_P62860 | STAM2 | GTCTATATGGTACTTGATCTACATATTAAGTGGAAAAATTAGCAGT ATTTGAAAGCTGAGT | SEQ ID NO: 2211 | Homo sapiens signal transducing adaptor molecule (SH3 domain and ITAM motif) 2 (STAM2), mRNA [NM_005843] |
| 631 | A_24_P630039 | AL049321 | AACAGAGACAATACAAAAGTTACATTTACATTTAAAACT GCAAGAAGACAGGGG | SEQ ID NO: 2212 | Homo sapiens mRNA; cDNA DKFZp564D156 (from clone DKFZp564D156). [AL049321] |
| 632 | A_24_P63347 | PF4V1 | CTACATATTTACCTTGAATGTACAATTAGCTGGCAATAAATAT TAGTAGCTCTTAAGC | SEQ ID NO: 2213 | Homo sapiens platelet factor 4 variant 1 (PF4V1), mRNA [NM_002620] |
| 633 | A_24_P62786 | THC2533996 | TGCTTGTTCGTATCTCAGCCCGAAGATGATTATCGTTGAGGAATG ACATTGAGCTTGTTT | SEQ ID NO: 2214 | HSU09954 ribosomal protein L9 [Homo sapiens] (exp=0; wgp=0; cg=0), partial (42%) [THC2533996] |
| 634 | A_24_P67100 | LOC646949 | AGTCATACCGCAGAAAAGATGGGGTGTTTCTTTATTTTGAAGATA ATGCAGGGGTCACAG | SEQ ID NO: 2215 | PREDICTED: Homo sapiens similar to ribosomal protein L23 (LOC646949), mRNA [XR_017241] |
| 635 | A_24_P675947 | ENST00000389400 | GTTCATGGCGAAGGTAGCAGTTCTCGAAAAAGCTACTGGAGAAGAG ACAGGTTCTAAAGTT | SEQ ID NO: 2216 | similar to 40S ribosomal protein S3a (V-fos transformation effector protein) (LOC391706), mRNA [Source:RefSeq_dna;Acc:XR_017186] [ENST00000389400] |
| 636 | A_24_P685729 | ENST00000389400 | TTGAAGCTTATGTTGATGTCAAGACTATCAGTGATTATTTGCTTT GTCTGTTTTGTGTGG | SEQ ID NO: 2217 | |
| 637 | A_24_P6975 | LOC342994 | GGAAAGACTTCGAGGGGGTTCGTGCTGTAAGACCTAAAGTTCTTATG AAAATGTCAAAAGA | SEQ ID NO: 2218 | PREDICTED: Homo sapiens similar to ribosomal protein L34 (LOC342994), mRNA [XM_938464] |
| 638 | A_24_P703614 | A_24_P703614 | AAGAACATACCCGAGTAATGGAGTCTGCACTGTAAGTGATCAGTAGC AGCTTTGTCTGTGTG | SEQ ID NO: 2219 | |
| 639 | A_24_P7181 | A_24_P7181 | TCATGGTCGGATTAACTCACAGTGATCTCTGGCTGCCACATGGA AATGATCTTTAGTGA | SEQ ID NO: 2220 | |
| 640 | A_24_P71938 | SMAD1 | TGTATTCACTTATGCTCTGCTGTACATTGAGTACTTTTATTCCAAAA CTAGTGGGTTTCTC | SEQ ID NO: 2221 | Homo sapiens SMAD family member 1 (SMAD1), transcript variant 1, mRNA [NM_005900] |
| 641 | A_24_P75158 | PTAR1 | CCATTAGATTTGTTCTTATGTGAAGCATGGTAGCACAGCCAGCTATAA AGTATGTATTTCTG | SEQ ID NO: 2222 | Homo sapiens mRNA; cDNA DKFZp313P0917 (from clone DKFZp313P0917). [AL832693] |
| 642 | A_24_P755505 | A_24_P755505 | ATACAGAAGACCTCTTATGCTCAGGACCAACAGAAAAGTAAAAT GCTGAAGAAGCCAA | SEQ ID NO: 2223 | |
| 643 | A_24_P76169 | ENST00000331306 | TTCTAAAATTCACTGCGACTTTCTCTAAGAAGTGTGGCAAGCATC AACCCGACAAAGTGA | SEQ ID NO: 2224 | PREDICTED: Homo sapiens similar to large subunit ribosomal protein L36a (LOC728202), mRNA [XM_001129191] |
| 644 | A_24_P76358 | LOC643981 | TTACTGAAGATGTTCAGGGCAAAAACTGCCTAACTTCCGGGCATGG ATCTTATTCGTGACA | SEQ ID NO: 2225 | PREDICTED: Homo sapiens similar to 40S ribosomal protein S3a (V-fos transformation effector protein) (LOC643981), mRNA [XR_018444] |
| 645 | A_24_P77681 | PAIP1 | AGCTGATCGAGATACCAAGAGAAATACCAAGAATACTTGAAAG AGAGGACTTTTTTCC | SEQ ID NO: 2226 | Homo sapiens poly(A) binding protein interacting protein 1 (PAIP1), transcript variant 1, mRNA [NM_006451] |
| 646 | A_24_P792734 | PSMC6 | AGAAACGTTAACGGAGTTACTGAATCAAATGGATTGATTGATACT CTGGATAGAGTTAAA | SEQ ID NO: 2227 | Homo sapiens proteasome (prosome, macropain) 26S subunit, ATPase, 6 (PSMC6), mRNA [NM_002806] |

Fig. 5-35

| No. | Probe ID No. | Symbols of genes | Sequence | SEQ ID NO: | Descriptions of genes (letters and numbers within [ ] indicates GenBank accession No.) |
|---|---|---|---|---|---|
| 647 | A_24_P813147 | TUBB8 | TACCTAACGGTGGCTGCCATTTTCAGGGGTCGCATGCCATCAGGGAGGTGGATGAACAA | SEQ ID NO: 2228 | Homo sapiens tubulin, beta 8 (TUBB8), mRNA [NM_177987] |
| 648 | A_24_P81965 | RAP2A | TTCTTTTGATGTTGCAACTTTTGGGTTCGTTCTTTAAACTGTGATAGTGATGGTAACTGATGC | SEQ ID NO: 2229 | Homo sapiens RAP2A, member of RAS oncogene family (RAP2A), mRNA [NM_021033] |
| 649 | A_24_P830667 | RPL21 | CTGTTCCTTTGGCGAACGTATATGCGAAATCTATAAGAAAGGTGATATTGTAGACATCAAGG | SEQ ID NO: 2230 | Homo sapiens ribosomal protein L21 (RPL21), mRNA [NM_000982] |
| 650 | A_24_P83968 | LOC730887 | ACAAAGCCCAGCAGGAACAACGTGGAACACAGAGAAAGTTTTTCTGGTGTCTCTAAGAAGC | SEQ ID NO: 2231 | PREDICTED: Homo sapiens similar to 40S ribosomal protein S7 (S8) (LOC730887), mRNA [XR_015607] |
| 651 | A_24_P84408 | A_24_P84408 | AAGGTACATCCAGCAGTGGTCATTGAGAAGTCATACCAGAGAAAAGATGGCGTGTTTCTT | SEQ ID NO: 2232 | |
| 652 | A_24_P84808 | LOC729449 | GAATTGCTTGGACAGATAACGCTTTGCGATCTCTTGGAAAATATGGCATCATCTGTATGG | SEQ ID NO: 2233 | PREDICTED: Homo sapiens similar to 60S ribosomal protein L7 (LOC729449), mRNA [XR_015548] |
| 653 | A_24_P857201 | AK022997 | CTGACATGTGATAAATATTTCAGTGACTTTTCAGATTTATTTCTTGTTAGCCGCTGTGTC | SEQ ID NO: 2234 | Homo sapiens cDNA FLJ12835 fis, clone NT2RP2004982. [AK022997] |
| 654 | A_24_P879895 | BC043357 | ACATACCTCAACTGCAACTGGTTTATGACACCTTGAATAAAAACAAAAGTGGCAG | SEQ ID NO: 2235 | Homo sapiens, clone IMAGE:3883659, mRNA. [BC043357] |
| 655 | A_24_P886040 | DCP2 | CATTTGGAACAAGGTTTCATTCTCGTTCTTAGATTTATGTGTTGTAGTTGAAACAGCAACTG | SEQ ID NO: 2236 | Homo sapiens DCP2 decapping enzyme homolog (S. cerevisiae) (DCP2), mRNA [NM_152624] |
| 656 | A_24_P880536 | CR627148 | AATTGCCTTCTTCTGTACCCCTAAGTATGGTGAAGCAGAATTGAATTCTACAAAAGTCTTTC | SEQ ID NO: 2237 | Homo sapiens mRNA; cDNA DKFZp779F2127 (from clone DKFZp779F2127). [CR627148] |
| 657 | A_24_P915806 | HNMT | GGAACAAGCTGCCAGGGCATAATAGGAAGAATACCAGAAATTGGCTGTTAACAAATAAATA | SEQ ID NO: 2238 | Homo sapiens histamine N-methyltransferase (HNMT), transcript variant 2, mRNA [NM_001024074] |
| 658 | A_24_P91852 | DYNLT3 | ATACATATAGAGAGGGAACCATAACTCATTGAATTTTGGAGAGGAATAAGCTTAGCGTT | SEQ ID NO: 2239 | Homo sapiens dynein, light chain, Tctex-type 3 (DYNLT3), mRNA [NM_006520] |
| 659 | A_24_P91916 | NXT2 | AAGCATGCTTCTTCTTGTAGTACTGATTGAAAAGTTACACGTTTATTCTAGTCATAGTGAGC | SEQ ID NO: 2240 | Homo sapiens nuclear transport factor 2-like export factor 2 (NXT2), mRNA [NM_018698] |
| 660 | A_24_P925505 | CD36 | CGTACCCTGTTTACCACAGTTGGTGTGTTTTATCTGTCGTAAGTACCAAATATGAATGGC | SEQ ID NO: 2241 | CD36=collagen type I/thrombospondin receptor [one exon] [human, mRNA Partial, 369 nt]. [S67044] |
| 661 | A_24_P931282 | THC2726401 | GGAAATATTTCCTGCTCAATGCATGAAATCATGTTGAAGTAATCTACTGGAGATTACAC | SEQ ID NO: 2242 | Q26195 PLAV1 (Q26195) Pval protein, partial (14%) [THC2726401] |
| 662 | A_24_P935986 | BCAT1 | ATGCTCTGAAGTTTTGTAGAAGCACAATTAAAGATCTAAAATGGCTTTGTTACACGGAGA | SEQ ID NO: 2243 | Homo sapiens branched chain aminotransferase 1, cytosolic (BCAT1), mRNA [NM_005504] |
| 663 | A_24_P937095 | SLC30A1 | TTTGATGTAGCTCTACCGATACTGTGGTAATGCTATTTGTTTTACTAACAAGCTCTG | SEQ ID NO: 2244 | Zinc transporter 1 (ZnT-1) (Solute carrier family 30 member 1). [Source:Uniprot/SWISSPROT;Acc:Q9Y6M5] [ENST00000367000] |
| 664 | A_24_P940426 | QKI | AAGCTGTTGAATGAGTCTTAAAAATTATACTAGTGTTAAGTGGACCAAGTTTGGTGAAGC | SEQ ID NO: 2245 | Homo sapiens quaking homolog, KH domain RNA binding (mouse) (QKI), transcript variant 4, mRNA [NM_206855] |
| 665 | A_24_P940776 | BDP1 | TCGAGGGGGAAATTGTCTATAAGTAGGCATTTATTTCATGATTGATATGTCAGAGAAATC | SEQ ID NO: 2246 | Homo sapiens B double prime 1, subunit of RNA polymerase III transcription initiation factor IIIB (BDP1), mRNA [NM_018429] |

Fig. 5-36

| No. | Probe ID No. | Symbols of genes | Sequence | SEQ ID NO: | Descriptions of genes (letters and numbers within [ ] indicates GenBank accession No.) |
|---|---|---|---|---|---|
| 666 | A_24_P941643 | PLCB1 | ATGATGTGCAGTTTTCTGCCTTTATGTATTTGCGTTGTTCTTTGTCGAATGTGTGAAATT | SEQ ID NO: 2247 | Homo sapiens phospholipase C, beta 1 (phosphoinositide-specific) (PLCB1), transcript variant 2, mRNA [NM_182734] |
| 667 | A_24_P941699 | PCGF5 | TGGTATATTCAACTACAGAGCTTTCTAAGGATAAGGAGTACTTCATGTCTAGTAATACAGTG | SEQ ID NO: 2248 | Homo sapiens polycomb group ring finger 5 (PCGF5), mRNA [NM_032373] |
| 668 | A_24_P98210 | TFEC | ACATGGGGCTTAGAAGTGCTTCTTGTCCAAGTAGTCTACCAATGAAAAGAGAAATTACAG | SEQ ID NO: 2249 | Homo sapiens transcription factor EC (TFEC), transcript variant 1, mRNA [NM_012252] |
| 669 | A_24_P99046 | STK38L | GCTATCTGTCTTTTGCTGATCTACAAATAAATGAATTGAGAATTTAGTCCATAGAGGTCC | SEQ ID NO: 2250 | Homo sapiens serine/threonine kinase 38 like (STK38L), mRNA [NM_015000] |
| 670 | A_32_P10100 | A_32_P10100 | TATGAGGAAATAGTATCATGATCATGTTAGAAGCCTTGGAATGAGTATAAATAATGGCTGGTC | SEQ ID NO: 2251 | |
| 671 | A_32_P105397 | THC2642694 | TAAAATGCTACTACAGTATTGTACGATGGAGGCTGAATGTATATTACAGTAATTCTCTGG | SEQ ID NO: 2252 | Q6TDT1_HUMAN (Q6TDT1) Protein transactivated by hepatitis B virus E antigen, partial (11%) [THC2642694] |
| 672 | A_32_P106732 | FANCM | AATCAAGCTGCTCAAGATGGGGTTTTCAAAGAGCGTCTCACATATTAAATGCAGTTCAAT | SEQ ID NO: 2253 | Homo sapiens Fanconi anemia, complementation group M (FANCM), mRNA [NM_020937] |
| 673 | A_32_P107372 | GBP1 | GGTACTGAGCAGAGTCGTTAGGTAAAAGTGTCTGGGAAATATTTGGGCATTGGTCTGGCCAA | SEQ ID NO: 2254 | Homo sapiens guanylate binding protein 1, interferon-inducible, 67kDa (GBP1), mRNA [NM_002053] |
| 674 | A_32_P107717 | BX100535 | TCTTGTCCACCCAAGATCTGCTCTCTGTTGTAAATCGTGTTCAGACCCTGGTCTAATTGGT | SEQ ID NO: 2255 | BX100535 Soares_testis_NHT Homo sapiens cDNA clone IMAGp998I094457, mRNA sequence [BX100535] |
| 675 | A_32_P109495 | THC2618720 | AAAGATATATCAGGCAACGAACAGTGGAGACTGCTCACCATGAATTTTTGGTTTGTTCATAAGA | SEQ ID NO: 2256 | |
| 676 | A_32_P109653 | THC2669092 | TGTGTTTGGTATTCGAAGTGGGGTCTTTTTCAGAATCTCTGCACTAGTCTGAGAATGCAA | SEQ ID NO: 2257 | |
| 677 | A_32_P113154 | LOC730861 | ACCACGAGTCCAAGAATCTGTTAAAGTTCAGACTTAAAACAGTACCAAATAAAAGTGC | SEQ ID NO: 2258 | PREDICTED: Homo sapiens similar to 40S ribosomal protein S3a (V-fos transformation effector protein) (LOC730861), mRNA [XR_015591] |
| 678 | A_32_P113584 | ZNF292 | GGGGCCTTTGGGTTTTATTGAATAGTTCATTTGACCTGTTAAGAGTTACTACCAATAAG | SEQ ID NO: 2259 | Zinc finger protein 292. [Source:Uniprot/SWISSPROT;Acc:O60281] [ENST00000339907] |
| 679 | A_32_P113742 | RPL21 | ATGTTCTCTAGGCCTTTTAGAAAAACATGGAGGAATGGGTACTGTTCAAAAAGGAATGCCC | SEQ ID NO: 2260 | Homo sapiens ribosomal protein L21, mRNA (cDNA clone IMAGE:6605832), complete cds. [BC104478] |
| 680 | A_32_P114215 | COMMD6 | AATTGCTATCATTCTAAAGTCATGGAGCTTCAGTTTCGGCAACAAACTAAATAAGGATGG | SEQ ID NO: 2261 | Homo sapiens COMM domain containing 6 (COMMD6), transcript variant 2, mRNA [NM_203495] |
| 681 | A_32_P1144 | AK091357 | GGGGACTTAATATTTTACATCTACTAGCCATGTCATAGGTTTTAAGTGCTTTTAATGGGG | SEQ ID NO: 2262 | Homo sapiens cDNA FLJ34038 fis, clone FCBBF2005645. [AK091357] |
| 682 | A_32_P11451 | NMD3 | CAGTTTAGGCAGGTAGCTGCTTTTGTCATAAATATCTTCGTACGACATCAAAAATGCTGC | SEQ ID NO: 2263 | Homo sapiens NMD3 homolog (S. cerevisiae) (NMD3), mRNA [NM_015938] |
| 683 | A_32_P115505 | ZNF294 | TGTGGTCAGAGAGTATATAGTTGAGAGTAAGTACTATGTGAGTTATAGATCTCTCGAA | SEQ ID NO: 2264 | Homo sapiens zinc finger protein 294 (ZNF294), mRNA [NM_015665] |

Fig. 5-37

| No. | Probe ID No. | Symbols of genes | Sequence | SEQ ID NO: | Descriptions of genes (letters and numbers within [ ] indicates GenBank accession No.) |
|---|---|---|---|---|---|
| 684 | A_32_P11931 | LOC441073 | GTGTGATGATCCCATGCCATCCGAAAAGGATGAGAAGTTCAGGTTGTACCGTGGACGACTATAAA | SEQ ID NO: 2265 | PREDICTED: Homo sapiens similar to 60S ribosomal protein L26 (Silica-induced gene 20 protein) (SIG-20) (LOC441073), mRNA [XR_016376] |
| 685 | A_32_P125549 | RPL31P4 | TCTACAGACAGTCAATGTCGATGAGAAGTAATCCCTGATCGTGCAGATACATCAAATAAAG | SEQ ID NO: 2266 | PREDICTED: Homo sapiens ribosomal protein L31 pseudogene 4 (RPL31P4), mRNA [XR_018222] |
| 686 | A_32_P125917 | THC2753798 | GCTTATAAAGTGTAAGTGGGAGAGGGCTAAATGTGTGAAGTACAAAGTTTCTTTTTCAGCAACAG | SEQ ID NO: 2267 | BF238843 601904455F1 NIH_MGC_54 Homo sapiens cDNA clone IMAGE:4132429 5', mRNA sequence [BF238843] |
| 687 | A_32_P128781 | A_32_P128781 | CATATATTGCATGGGGGTACCCAATCTGAAGTCAGTAAATGAACTAATCTACAAGAGTG | SEQ ID NO: 2268 | |
| 688 | A_32_P135818 | RPS3A | CTTGCTTCATCTGTTCTGTGTTGGTTTTAATAAAAACGGACAATCAGATATGGAAGAC | SEQ ID NO: 2269 | Homo sapiens ribosomal protein S3A (RPS3A), mRNA [NM_001006] |
| 689 | A_32_P136319 | RPL36A | AAGTGATCCAGTTGTAAGTGTCATCTTTATCATGAAGACAATAAAATCTTGAGTTTATG | SEQ ID NO: 2270 | Homo sapiens ribosomal protein L36a (RPL36A), mRNA [NM_021029] |
| 690 | A_32_P137266 | KIAA1799 | AAGTGGGACGCAAATCTAGAATGGTTTGTCAACATGTAATGCTTTGAATGAACGGACAAG | SEQ ID NO: 2271 | Homo sapiens KIAA1799 protein (KIAA1799), mRNA [NM_032437] |
| 691 | A_32_P143323 | CR613267 | AGAGAGCTCAAACGAATGGGGTTTATGCCAGTTACATACAAGGATCGTGCATATTTCAGGG | SEQ ID NO: 2272 | full-length cDNA clone CS0DL011YP14 of B cells (Ramos cell line) Cot 25-normalized of Homo sapiens (human) [CR613267] |
| 692 | A_32_P145153 | RPL31 | ATCGGTGTGCAGGTGTCCAGAAAAACTAATGAGGATGAAGATTCACCAAATAAGCATAT | SEQ ID NO: 2273 | Homo sapiens ribosomal protein L31 (RPL31), mRNA [NM_000993] |
| 693 | A_32_P145159 | A_32_P145159 | GATACATTGGGGTGTACATAAACGTTTGTGGAAAACTTAGTTGTGTGATTATTCTCTTTG | SEQ ID NO: 2274 | |
| 694 | A_32_P145477 | BX350256 | TGGCAAGCATCCTAAGAAGAACGGAAACCCAAGGGAACAGAGATGTCTACATAGGACTGTA | SEQ ID NO: 2275 | BX350256 BX350256 Homo sapiens PLACENTA COT 25-NORMALIZED Homo sapiens cDNA clone CS0DI081YM18 3-PRIME, mRNA sequence [BX350256] |
| 695 | A_32_P147747 | THC2575761 | TTGATACGTCTGATTCTGATGACAAACAGCGAATTGGGTTCTGCAGGTAGATAGAAGTTG | SEQ ID NO: 2276 | HUMRPL7Y ribosomal protein L7 [Homo sapiens] (exp=-1; wgp=0; cg=0) partial (40%) [THC2575761] |
| 696 | A_32_P148824 | C1orf27 | GAAAAAGAGATGTTATCCTCAGGAGAAAATTCAGTAAGAGACTACAAAGGATGATCTC | SEQ ID NO: 2277 | Homo sapiens chromosome 1 open reading frame 27 (C1orf27), mRNA [NM_017847] |
| 697 | A_32_P1515 | AA714637 | CTGAGCATAAGAGGGTCTTCCGTATCTGATTTTTTGGGTTTTTTAGTAAAACCAACAGAA | SEQ ID NO: 2278 | nw20g12.s1 NCI_CGAP_GCB0 Homo sapiens cDNA clone IMAGE:1241062 3' similar to gb:M84711 40S RIBOSOMAL PROTEIN S3A (HUMAN);, mRNA sequence [AA714637] |
| 698 | A_32_P153725 | KIAA1033 | TTTTGTAAAAGATGGCAAGTTTGTTACGTCACTTGAGTGGGGTTTTCCTTTTCCCCAAT | SEQ ID NO: 2279 | Homo sapiens KIAA1033 (KIAA1033), mRNA [NM_015275] |
| 699 | A_32_P156364 | RPL7 | TCAACAGGGTTATTAGAAAAATGAACCAAGGTGTCTACCATGATTATTTTCTAAGCTGG | SEQ ID NO: 2280 | Homo sapiens ribosomal protein L7 (RPL7), mRNA [NM_000971] |
| 700 | A_32_P155811 | CD2AP | AAAGGATGCTTCTCTCAAAAAGAAAATTAAAGGATTTATTGCCAGTCGTGTCAGTC | SEQ ID NO: 2281 | Homo sapiens CD2-associated protein (CD2AP), mRNA [NM_012120] |
| 701 | A_32_P158746 | RPL17 | TTTTGCTGACATGGCTAAAAAATGCAGAGACTAATGGTGAACTTAAGGGTTTAGATGTAG | SEQ ID NO: 2282 | Homo sapiens ribosomal protein L17 (RPL17), transcript variant 1, mRNA [NM_000985] |
| 702 | A_32_P158966 | KLRF1 | TACGTGATAGTATAAACCAATCTGACTTGATGTGATCATCCAGGATTTTTATTCGGTCG | SEQ ID NO: 2283 | Homo sapiens killer cell lectin-like receptor subfamily F, member 1 (KLRF1), mRNA [NM_016523] |

Fig. 5-38

| No | Probe ID No. | Symbols of genes | Sequence | SEQ ID NO: | Descriptions of genes (letters and numbers within [ ] indicates GenBank accession No.) |
|---|---|---|---|---|---|
| 703 | A_32_P159651 | PCAF | GAGTGGTGTCTAGATTTCTAATGAAGAATCATGATACAGTTTGGATTAAGTATGTTGGAC | SEQ ID NO: 2284 | Homo sapiens p300/CBP-associated factor (PCAF), mRNA [NM_003884] |
| 704 | A_32_P162250 | ARHGAP18 | AAGTCCTGAATAAGTCACTGGAAGAATATTCTTCTGGGTGAAAAAGCTTTTGTTGTG | SEQ ID NO: 2285 | Homo sapiens Rho GTPase activating protein 18 (ARHGAP18), mRNA [NM_033515] |
| 705 | A_32_P164203 | THC2883448 | TTGATGGTCATTGTACGGAGCTATTGTATGGATTACTGTGGAGTGCTGTTTACCACATGAT | SEQ ID NO: 2286 | Q7WZG3_PASP1 (Q7WZG3) Ferric uptake regulator, partial (9%) [THC2883448] |
| 706 | A_32_P165340 | SRP9 | ACATTGAAATATGTTTTGTATAAATTTGTCATGTTGAACAACATTTAGGATGGTAAGTT | SEQ ID NO: 2287 | Homo sapiens signal recognition particle 9kDa (SRP9), mRNA [NM_003133] |
| 707 | A_32_P167122 | RCOR3 | GTATCTGAGGGATGTGCTGTAATCTGATTAGACATGAATTAGAGCACACAGTAGAAAAACT | SEQ ID NO: 2288 | Homo sapiens REST corepressor 3 (RCOR3), mRNA [NM_018254] |
| 708 | A_32_P170444 | SUB1 | TAGGTATCTCTCCTGAAATTCTTTGCAGTTCATTTTTATGGCAGTTAATCCAGTGAAAC | SEQ ID NO: 2289 | Activated RNA polymerase II transcriptional coactivator p15 (SUB1 homolog) (Positive cofactor 4) (PC4) (p14). [Source:Uniprot/SWISSPROT;Acc:P53999] [ENST00000265073] |
| 709 | A_32_P170736 | AK098422 | ACGTCATAATTGTTGAGGGCAAGGTTCATTGTTGATAGTGGAAAGTGTCGGCTGTTGTGAT | SEQ ID NO: 2290 | Homo sapiens cDNA FLJ25556 fis, clone JTH02629. [AK098422] |
| 710 | A_32_P17163 | ENST00000368149 | TCCTTAGTGAGTTTAAATCTCAGGCTAGATTTTATTGTTTTCTGTGTGTGTATGAG | SEQ ID NO: 2291 | Rho GTPase-activating protein 18 (MacGAP). [Source:Uniprot/SWISSPROT;Acc:Q8N392] [ENST00000368149] |
| 711 | A_32_P173385 | ENST00000334683 | AAATGCAAGAGTGATGGTGAACTTAAGGGTCAGATGTAGATTCTCTGGTCATTGAGCA | SEQ ID NO: 2292 | PREDICTED: Homo sapiens similar to 60S ribosomal protein L17 (L23) (LOC650848), mRNA [XR_019013] |
| 712 | A_32_P17504 | THC2698682 | ATGTCTATGCTGTTTCAGTCTGCAAATATTCCCAGCTTTTCCCCTTGATGCCAAA | SEQ ID NO: 2293 | |
| 713 | A_32_P176819 | CMAH | GATTATATAGCTAGGTCTGATTCTGAAGATACAAGAATTGAATGGTGGAATTTGTCTCG | SEQ ID NO: 2294 | Homo sapiens cytidine monophosphate-N-acetylneuraminic acid hydroxylase (CMP-N-acetylneuraminate monooxygenase) (CMAH) on chromosome 6 [NR_002174] |
| 714 | A_32_P177685 | THC2632286 | TTTGACTGAGTATTTGTAGATGCTTAATGACTGAAATGAATTTGGAGGCACTGATGAAAG | SEQ ID NO: 2295 | AA665072 nu76b01.s1 NCI_CGAP_Alv1 Homo sapiens cDNA clone IMAGE:1216585, mRNA sequence [AA665072] |
| 715 | A_32_P179045 | YOD1 | TTGCCAGCATTTTGAAGTAATACAGTGCTGCTACCTGGAAGATGTCTAAGTTCATTT | SEQ ID NO: 2296 | Homo sapiens YOD1 OTU deubiquinating enzyme 1 homolog (S. cerevisiae) (YOD1), mRNA [NM_018566] |
| 716 | A_32_P179966 | ENST00000379426 | GTAATATACAGGGTGAAGCTCTTACTGATACACACAAGACAACTGTTAAAAGTGAATCC | SEQ ID NO: 2297 | Novel protein. [Source:Uniprot/SPTREMBL;Acc:Q5T4T1] [ENST00000379426] |
| 717 | A_32_P180435 | WBSCR19 | CTTTCAATCTTTGTATCTATCTATTATTACACGTGCTGCTGAAGGGAGCATGTTTTATCATG | SEQ ID NO: 2298 | Homo sapiens Williams Beuren syndrome chromosome region 19 (WBSCR19), mRNA [NM_175064] |
| 718 | A_32_P188961 | RPL17 | CATTGAGATGATCCTTACGGAAAAAGGAACAAGATTGTTCTAAACCAGAAGAGGAGGTTGC | SEQ ID NO: 2299 | Homo sapiens ribosomal protein L17 (RPL17), transcript variant 1, mRNA [NM_000985] |
| 719 | A_32_P190438 | hCG_26523 | GCCAGCAAGGTGGTTATCACTAGGCTAAAACTGGACAAGACGGGAAAAAGATCCTTGAA | SEQ ID NO: 2300 | PREDICTED: Homo sapiens similar to 60S ribosomal protein L26 (LOC646161), mRNA [XR_018048] |

Fig. 5-39

| No. | Probe ID No. | Symbols of genes | Sequence | SEQ ID NO: | Descriptions of genes (letters and numbers within [ ] indicates GenBank accession No.) |
|---|---|---|---|---|---|
| 720 | A_32_P192480 | ENST00000370857 | TAGTGCTGTAGTGCTTGTGTTTATGTTTAAAAGTGCACATTATGCAGCTCATTTTAGTATGC | SEQ ID NO: 2301 | Muscleblind-like X-linked protein (Muscleblind-like protein 3) (Cys3His CCG1-required protein) (Protein MCHCR). [Source:Uniprot/SWISSPROT;Acc:Q9NUK0] [ENST00000370857] |
| 721 | A_32_P193322 | RICTOR | ACCACATGAGTTCTTCTGTTTTTATTTAGTAATAACGGCTGCTACATATTTGGAGGTTCTGG | SEQ ID NO: 2302 | Homo sapiens rapamycin-insensitive companion of mTOR (RICTOR), mRNA [NM_152756] |
| 722 | A_32_P194421 | RPL21 | GAACGACAAAGAGAAGAAGAGGAGGGCACCCGGATATATGTTCTTTAGGCGTTTTAGAAAACA | SEQ ID NO: 2303 | Homo sapiens ribosomal protein L21 (RPL21), mRNA [NM_000982] |
| 723 | A_32_P195387 | DKFZP779L1068 | ATATAACCTTGGAATTCTATTCTAATTATGTTGTTCTGGGTGGTTGTAGTATCAGTTGGG | SEQ ID NO: 2304 | Homo sapiens cDNA clone IMAGE:5555490. [BC110326] |
| 724 | A_32_P196047 | DPY19L4 | ATATTAAGATAGTTGCAGGCAGTGTACCTCAGGTTGACTGTGTACATCTGAATAGTGAGT | SEQ ID NO: 2305 | Homo sapiens dpy-19-like 4 (C. elegans) (DPY19L4), mRNA [NM_181787] |
| 725 | A_32_P196483 | RPS3A | CGGGGCAAGAAGAAGTGGTTGATCGATTTCTTAAGAAAGATTGGTATGATGTGAAAGCA | SEQ ID NO: 2306 | Homo sapiens ribosomal protein S3A (RPS3A), mRNA [NM_001006] |
| 726 | A_32_P19752 | FAM76B | TTGTGCTTTTAGGCTGTTTTCCACTATTAATTAGCATTACCAGTAAGGGTCATTTTGAC | SEQ ID NO: 2307 | Homo sapiens family with sequence similarity 76, member B (FAM76B), mRNA [NM_144664] |
| 727 | A_32_P20240 | SP3 | CTTAGGCTCTTAATTGTAGTTTAAATTCCAGTACTAGCTGGCTACTGACCCCAAAAGTTTGT | SEQ ID NO: 2308 | Homo sapiens mRNA; cDNA DKFZp686N17231 (from clone DKFZp686N17231), mRNA [BX648577] |
| 728 | A_32_P202488 | RPL21 | AAGAAGGAGAGCCACCGGATATATGTTCTCTAGGCCTTTTAGAAAACATGGGAATGGGTAC | SEQ ID NO: 2309 | Homo sapiens ribosomal protein L21, mRNA (cDNA clone IMAGE:6605832), complete cds. [BC104478] |
| 729 | A_32_P203154 | RPL21 | CTTTGGCCACGTGTATGTGAATTCTATAAGAAAGGTGATATTGTAGAGTCAAGGGAATGG | SEQ ID NO: 2310 | Homo sapiens ribosomal protein L21 (RPL21), mRNA [NM_000982] |
| 730 | A_32_P203320 | ROCK1 | AACGGCCATCACTACTATCCAAAGATCAGGCTGATGGAAGGAGTAAGAAAATATCTCAAAATGAG | SEQ ID NO: 2311 | Homo sapiens Rho-associated, coiled-coil containing protein kinase 1, mRNA (cDNA clone IMAGE:5269982), complete cds. [BC041849] |
| 731 | A_32_P20367 | RPS7 | ATCCTTGAGGACTTGGTCTTCACAAGCAAATAATGTGGGAAGAAATGCGGCTGAAACTA | SEQ ID NO: 2312 | Homo sapiens ribosomal protein S7 (RPS7), mRNA [NM_001011] |
| 732 | A_32_P204330 | AK093982 | AAAGCCTGAGCTTTTTGCTCGTCTGTTGTAGCAGATATCGTAAAAACCTACCCAGAATTG | SEQ ID NO: 2313 | Homo sapiens cDNA FL36663 fis, clone UTERU2002826. [AK093982] |
| 733 | A_32_P205550 | RPL26L1 | AGGTAGTTCGAGGACACTACAAAGGTCAGCAAATTGGCAAGGTAATCCAGGTGTGACGAA | SEQ ID NO: 2314 | Homo sapiens ribosomal protein L26-like 1 (RPL26L1), mRNA [NM_016093] |
| 734 | A_32_P205553 | RPL26L1 | TCGGAATTGTCTGGAACATTTCATTTCCTGTTTTGTTACCTGTGGGCTCTGTAAATGTACT | SEQ ID NO: 2315 | Homo sapiens ribosomal protein L26-like 1 (RPL26L1), mRNA [NM_016093] |
| 735 | A_32_P207231 | AI630435 | TTCCTTCGCTTTTCTTTAAGGGTTTCTGGAACGACAGGAACCTGCTTGTTCTTGTCTTCT | SEQ ID NO: 2316 | AI630435 adi0b05.y1 Hembase; Erythroid Progenitor Cells (LCB:ad library) Homo sapiens cDNA clone adi0b05 random, mRNA sequence [AI630435] |
| 736 | A_32_P208178 | RPS3A | GGAAAAGACGTAGAAAAGGGTTGGAATTCTATTTATCGTCGATGATGCTCATTTACAGAAAACAGTGTGT | SEQ ID NO: 2317 | Homo sapiens ribosomal protein S3A (RPS3A), mRNA [NM_001006] |
| 737 | A_32_P21384 | RPL17 | ACGATGTCACTTTACAGAAAACAGTGTGTACGATTCCGACATTACAACGGTCGGAGTTGGCAG | SEQ ID NO: 2318 | Homo sapiens ribosomal protein L17 (RPL17), transcript variant 1, mRNA [NM_000985] |
| 738 | A_32_P219031 | RPL21 | AGAGGCACCGGATATATGTTCTCTAGGCCTTTTAGAAAACATGGAACGGGTACTGTTCA | SEQ ID NO: 2319 | Homo sapiens ribosomal protein L21, mRNA (cDNA clone IMAGE:6605832), complete cds. [BC104478] |

Fig. 5-40

| No. | Probe ID No. | Symbols of genes | Sequence | SEQ ID NO: | Descriptions of genes (letters and numbers within [ ] indicates GenBank accession No.) |
|---|---|---|---|---|---|
| 739 | A_32_P220127 | RPL34 | CAAAACTAGGGTGTCGTGAACCCCTGGTAATAGAATTGTTCACCT TTATACGAAGAAGGT | SEQ ID NO: 2320 | Homo sapiens ribosomal protein L34 (RPL34), transcript variant 2, mRNA [NM_033625] |
| 740 | A_32_P223319 | ESCO1 | ATGCCCTGATTAGTGGACTTCATTTTGATACTTGTGTATCGTTCA TAGTGCCGTCTACTT | SEQ ID NO: 2321 | Homo sapiens establishment of cohesion 1 homolog 1 (S. cerevisiae) (ESCO1), mRNA [NM_052911] |
| 741 | A_32_P224655 | CAPZA2 | AATGCTGTTTTCAGATTCTGAAATTAAATGAAAATACTTATTTCA GAAATATGTTTAATG | SEQ ID NO: 2322 | Homo sapiens capping protein (actin filament) muscle Z-line, alpha 2 (CAPZA2), mRNA [NM_006136] |
| 742 | A_32_P22539 | hCG_26523 | ACTACGAAGGTCAGCAAATTGGCAAAGTGGTCCAGGTTTACAGGA AGAATATGTTATCT | SEQ ID NO: 2323 | PREDICTED: Homo sapiens similar to 60S ribosomal protein L26 (Silica-induced gene 20 protein) (SIG-20) (LOC400055), mRNA [XM_374987] |
| 743 | A_32_P226786 | BC045174 | TTATTGGTGCATGTAAGGCATTATCCTGTCTTAATGAACCGATTA ATGCTGTTGATTGTT | SEQ ID NO: 2324 | Homo sapiens cDNA clone IMAGE:5273245. [BC045174] |
| 744 | A_32_P2333 | SUB1 | AGGAAGAAAAGGTATTTCTTTAAATCCAGAACAATGGAGCCAGGT GACGAACAGATTTC | SEQ ID NO: 2325 | Homo sapiens SUB1 homolog (S. cerevisiae) (SUB1), mRNA [NM_006713] |
| 745 | A_32_P26895 | KIAA1600 | AATTCTTGGTCCCTCCGGTGGAGAAAAGATGGCGTGTTGTTTATTTGA TAGCTAGTCTCTCTT | SEQ ID NO: 2326 | KIAA1600 (KIAA1600), mRNA [Source:RefSeq_dna;Acc:NM_020940] [ENST00000369248] |
| 746 | A_32_P30710 | RPL23 | ACGAAAGTCATACCGTAGAAAAAGATGGCGTGTTTGTTATTTGA AGATATGCAGGAGT | SEQ ID NO: 2327 | Homo sapiens ribosomal protein L23 (RPL23), mRNA [NM_000978] |
| 747 | A_32_P31182 | RPL7 | GTAGAAGAAGAAGAAGAGGTTCCGTCGTGCCAGAAAACCCTTAAG AAAAAGGAAGGAAT | SEQ ID NO: 2328 | Homo sapiens ribosomal protein L7 (RPL7), mRNA [NM_000971] |
| 748 | A_32_P335445 | HINT1 | GTGATACCCAAGAAACATATATCCAGATTTCTGTGGACAAGAT GATCATGAAAGTCTT | SEQ ID NO: 2329 | Homo sapiens histidine triad nucleotide binding protein 1 (HINT1), mRNA [NM_005340] |
| 749 | A_32_P36101 | ARL1 | CTATTCAAACACAGATGCAGTCATTTATGTAGTAGAACAGTTGTGA CCGAGACCGAATTGG | SEQ ID NO: 2330 | Homo sapiens ADP-ribosylation factor-like 1 (ARL1), mRNA [NM_001177] |
| 750 | A_32_P43217 | PSMA6 | TTGTTGTTAGTTTAGCAGATCCGTGATGCCAGTTACCTGTGTGTT TGGTAACAACAACA | SEQ ID NO: 2331 | Homo sapiens proteasome (prosome, macropain) subunit, alpha type, 6 (PSMA6), mRNA [NM_002791] |
| 751 | A_32_P4532 | LOC643932 | GATTCCAGAGAGCAGGCATTGGAAAAGACATAGAAAAAGGCTTGCCAATC TATGCTCTCCATGAT | SEQ ID NO: 2332 | PREDICTED: Homo sapiens similar to 40S ribosomal protein S3a (V-fos transformation effector protein) (LOC643932), mRNA [XR_017289] |
| 752 | A_32_P49164 | AV714556 | AAATGCAGAGTTTGTTATTTGCCAAAGAAGAATTCATCATGTTCCT TCCTTTCTTTTTCCC | SEQ ID NO: 2333 | AV714556 AV714556 DCB Homo sapiens cDNA clone DCBAD606 5', mRNA sequence [AV714556] |
| 753 | A_32_P49392 | A_32_P49392 | AATTCTGCCAAATCTGGAAGAACATGATGGAAATCATGACCCAAG AGGTGCAGACAAATG | SEQ ID NO: 2334 | |
| 754 | A_32_P54305 | LOC401397 | AGAATGTTAGGAAATCACCACTGTTCGGTTATATAATCACTGCCTC TGAATGCTTGAGGAG | SEQ ID NO: 2335 | Homo sapiens hypothetical LOC401397, mRNA (cDNA clone IMAGE:4244115), complete cds. [BC107860] |
| 755 | A_32_P58074 | RPS3A | GTTGGTTTACTAAAAAACGCAAAAATCAGATACGGAAGAGCTGT TATGCTCAGGACAA | SEQ ID NO: 2336 | Homo sapiens ribosomal protein S3A (RPS3A), mRNA [NM_001006] |
| 756 | A_32_P61857 | KIAA1468 | TCAGTGTACAGTTCGACTGGAATTTGACAGTTGTCTCTACAGTCA TGCAACTCGAAGTAG | SEQ ID NO: 2337 | Homo sapiens KIAA1468 (KIAA1468), mRNA [NM_020854] |
| 757 | A_32_P68686 | ARL1 | TTGGGTTAGGTGCGTTGAAGGACCGAAAATGGCAGATATTCAAAA CGTCAGGCAACCAAAG | SEQ ID NO: 2338 | Homo sapiens ADP-ribosylation factor-like 1 (ARL1), mRNA [NM_001177] |
| 758 | A_32_P7118 | PSMC6 | AGCAGACCTGAGAAATTTGTACTGAAGCAGGTATGTTGGCAAT TCGTGCTGATGATGA | SEQ ID NO: 2339 | Homo sapiens proteasome (prosome, macropain) 26S subunit, ATPase, 6 (PSMC6), mRNA [NM_002806] |

Fig. 5-41

| No. | Probe ID No. | Symbols of genes | Sequence | SEQ ID NO: | Descriptions of genes (letters and numbers within [ ] indicates GenBank accession No.) |
|---|---|---|---|---|---|
| 759 | A_32_P73222 | AA631847 | TTTCTTGTTTTGGACAATCTCATAAGAAGTTTAGGTCTTACAGC ACGAACGCGTGGAAG | SEQ ID NO: 2340 | np61b02.s1 NCI_CGAP_Br2 Homo sapiens cDNA clone IMAGE:1130763 3' similar to TR:G971838 G971838 60S RIBOSOMAL PROTEIN L34 ; mRNA sequence [AA631847] |
| 760 | A_32_P77102 | BC042469 | AAATGTGAAGTCTGGCTTGAAGAGGGTGTATAAGACACATAATT TACTGTGCATCAGTC | SEQ ID NO: 2341 | Homo sapiens, clone IMAGE:5198554, mRNA. [BC042469] |
| 761 | A_32_P81768 | TMEM167 | CCTCAGTACTGTGACTACAGTATTACATTCTGCAAATGTTATTCT GTTGTATGAAGATACG | SEQ ID NO: 2342 | Homo sapiens transmembrane protein 167 (TMEM167), mRNA [NM_174909] |
| 762 | A_32_P83784 | CENTD1 | ACAGGCCCATACTTCAGTCAGTCGAATCATAGTACAGTGATGTGG TGGTAGATGCTATGA | SEQ ID NO: 2343 | Homo sapiens centaurin, delta 1 (CENTD1), transcript variant 1, mRNA [NM_015230] |
| 763 | A_32_P86400 | LYSMD3 | AAATGTTGCTCAGGTAATCAGTATTTCTTCCACGTATGTGGATA TTGGACTGTTAGATC | SEQ ID NO: 2344 | Homo sapiens LysM, putative peptidoglycan-binding, domain containing 3 (LYSMD3), mRNA [NM_198273] |
| 764 | A_32_P86494 | A_32_P86494 | TGAGCCTTGCCTGCCACATTGAGATGCTTACTGAAAAGGAAC AGATTGTTCCTAAAC | SEQ ID NO: 2345 | |
| 765 | A_32_P8857 | A_32_P8857 | TAATGTCGGAAATGGTACACACTGTTTCTGTAAAGTGACATCTTTC AGATACTTGGTGGCT | SEQ ID NO: 2346 | |
| 766 | A_32_P93782 | RPL26 | AGGTGTACATGGACAGCTATAAAGGTCAGCAAATTGGCAAAGTAG TCCAGGTTTACAGA | SEQ ID NO: 2347 | Homo sapiens ribosomal protein L26 (RPL26), mRNA [NM_000987] |
| 767 | A_32_P9382 | RP11-11C5.2 | AACAAAGCAGGAAAATATATTGAGAAGGGATCGTGTTACAGAGG ACTTGTTTAAAGTGT | SEQ ID NO: 2348 | Homo sapiens similar to RIKEN cDNA 2410129H14 (LOC440145), mRNA [NM_001071775] |
| 768 | A_32_P96134 | DPY19L1 | ATAACTGCTTCATTTGCTGGGAACCATTACAAGTAGTATAAATTA GCTTTTTCCAGAAGG | SEQ ID NO: 2349 | Homo sapiens DPY-19-like protein 1 (DPY19L1) mRNA, complete cds. [DQ287932] |
| 769 | A_32_P96213 | TPT1 | GAAAGCACAGTAATCACTGCTGTGATGTTCTCATGAACCATCAC CTGCAGGAAACAAGT | SEQ ID NO: 2350 | Homo sapiens tumor protein, translationally-controlled 1 (TPT1), mRNA [NM_003295] |
| 770 | A_32_P96933 | AL571926 | GAGCCTGACAAATGTTCTCGGATGTAACAGTATGAACACCTATGAG CTGGGACTACTTCTG | SEQ ID NO: 2351 | AL571926 Homo sapiens PLACENTA COT 25-NORMALIZED Homo sapiens cDNA clone CS0D1029Y06 3-PRIME, mRNA sequence [AL571926] |
| 771 | A_32_P98313 | NDUFA4 | AGCCCGTGAACAAACTGGGTCCCAATGATGAATACAAGTTCTGCT CAGTGAATGTGGATT | SEQ ID NO: 2352 | Homo sapiens NADH dehydrogenase (ubiquinone) 1 alpha subcomplex, 4, 9kDa (NDUFA4), nuclear gene encoding mitochondrial protein, mRNA [NM_002489] |

Fig. 6-1

| No. | Probe ID No. | Symbols of genes | Sequence | SEQ ID NO. | [description] |
|---|---|---|---|---|---|
| 1 | A_23_P143247 | TSHZ2 | TTGCAAGAGCAGTAGGAATCTGTAATTCTTAAGTTACGGAACAGTCTCAA TGAATCACTATAATCA | SEQ ID NO: 1593 | Homo sapiens teashirt family zinc finger 2 (TSHZ2), mRNA [NM_173485] |
| 2 | A_23_P94938 | NOG | GCAGAGCTGCTGGGTGGATTTGAATAACATCCAGTAGGCCATAATTCC AATCCAAATTGTCGT | SEQ ID NO: 1601 | Homo sapiens noggin (NOG), mRNA [NM_005450] |
| 3 | A_23_P653158 | ANKRD15 | TTTACCGTTTCACTTTCATTTGTGGTTTATGTATTAAATT | SEQ ID NO: 1611 | Homo sapiens ankyrin repeat domain 15 (ANKRD15), transcript variant 1, mRNA [NM_153186] |
| 4 | A_23_P4399 | CNTNAP2 | CTTAGCCATTCTAAAATAACAGAGAATTGGGAGGGG | SEQ ID NO: 1614 | Homo sapiens contactin associated protein-like 2 (CNTNAP2), mRNA [NM_014141] |
| 5 | A_24_P909963 | IMAGE | CCAATGAATACATATG GCCCATTCAAGATAGCAGAGAAAAATTGCTCTTAAAT | SEQ ID NO: 1644 | Homo sapiens cDNA clone IMAGE:5284679 [BC040600] |
| 6 | A_24_P111934 | THC2643957 | AAGTATAGGTAAAAC | SEQ ID NO: 1651 | |
| 7 | A_32_P208682 | THC2663497 | CAATGTTAAGCCAATATCAAGTCCTTTTTGAAGAATTTGAA AAGGTATTTGGTGAT | SEQ ID NO: 1626 | ALU1_HUMAN (P39188) Alu subfamily J sequence contamination warning entry, partial (5%) [THC663167] |
| 8 | A_32_P213569 | THC2665836 | GATTTTTCAATGTTGACCCTTTTAATGAAAATTCTCAAC ACGTAAGTGGAAAA | SEQ ID NO: 1680 | |
| 9 | A_32_P227110 | THC2612340 | TAAGCAATTGGATCTTTGATTTGCCATCTGTATTAATGAC TTATTATTATAACTCA | SEQ ID NO: 1684 | |
| 10 | A_23_P26930 | PSMC6 | GAAGAAGAAATTTAAGACTAGACACTACAAATGAACGAAGCTCCAT TACAAAGCATGGTAAA | SEQ ID NO: 1737 | Homo sapiens proteasome (prosome, macropain) 26S subunit, ATPase, 6 (PSMC6), mRNA [NM_002806] |
| 11 | A_23_P134925 | BNIP3L | ATTGTTATTTCAGTGTATATTAGATATTGATATTCAAGT AAAGTCATTGGTCCCAA | SEQ ID NO: 1746 | Homo sapiens BCL2/adenovirus E1B 19kDa interacting protein 3-like (BNIP3L), mRNA [NM_004331] |
| 12 | A_23_P137380 | C1QB | TGTAGTATCCATATGTGGTTAAATTTGTTATGCGCCCATCA TTTTTCCGGTTTGC | SEQ ID NO: 1750 | Homo sapiens complement component 1, q subcomponent, B chain (C1QB), mRNA [NM_000491] |
| 13 | A_23_P107404 | RNF11 | TGTAGTATTCAATATGTGGTTAAATTTGTTATGCGCCCGATGA TCAAAACATTTAAAA | SEQ ID NO: 1751 | Homo sapiens ring finger protein 11 (RNF11), mRNA [NM_014372] |
| 14 | A_23_P143368 | RPL22L1 | ATTTATTTCTAGATTA GATTATTTTGAGATTA | SEQ ID NO: 1757 | Homo sapiens cDNA clone IMAGE:4552860 [BC040479] |
| 15 | A_23_P144487 | RPS3A | CGAAATCCAAAGAACAATTGAAATCATGAGCGAAGAAGTTGA AGAAAACATGATTGAA | SEQ ID NO: 1763 | Homo sapiens ribosomal protein S3A (RPS3A), mRNA [NM_001006] |
| 16 | A_23_P14706 | SH3HW4 | TCTTTGTTAGGTGATACAAATGTTTAGCGTGCCAGGGGTGTAGACT TAGGTAATTAAACT | SEQ ID NO: 1766 | Homo sapiens suppressor of hairy wing homolog 4 (Drosophila) (SUHW4), transcript variant 1, mRNA [NM_019105] |
| 17 | A_23_P14734 | RPS27L | TACAAATCAGCAGCTTTTTCATTTGAAGGTATGTCATGCAAGAAACTTG TAGTTAATTAAACT | SEQ ID NO: 1769 | Homo sapiens ribosomal protein S27-like (RPS27L), mRNA [NM_015920] |
| 18 | A_23_P163662 | BCL2A1 | CTCGCATTTCTTTTA GTACCAAGCAAATTGC TACGACAAGCAAAATTCC | SEQ ID NO: 1775 | Homo sapiens BCL2-related protein A1 (BCL2A1), mRNA [NM_004049] |
| 19 | A_23_P168842 | EEF1E1 | AAGGATAAATGAAAATTTCAGAGGTAGGTCAGCAAGCAAGAAACTGG CAAGTTAATGGCACT | SEQ ID NO: 1778 | Homo sapiens eukaryotic translation elongation factor 1 epsilon 1 (EEF1E1), mRNA [NM_004280] |

Fig. 6-2

| No. | Probe ID No. | Symbols of genes | Sequence | SEQ ID NO: | Descriptions of genes (letters and numbers within [ ] indicates GenBank accession No.) |
|---|---|---|---|---|---|
| 20 | A_23_P157449 | POLR2K | GGTCTCTGTTGCTTCAAATATGTTCTTGTACAGTAGTCACCAT TTTAGATGTTGGTTGAC | SEQ ID NO: 1779 | Homo sapiens polymerase (RNA) II (DNA directed) polypeptide K, 7.0kDa (POLR2K), mRNA [NM_005034] |
| 21 | A_23_P157452 | POLR2K | GGGAATGTCTTCAGTTATACTTGGATTTGCTCGTCTCTCCGATTCT GATTGTTGTATAGGTT | SEQ ID NO: 1780 | Homo sapiens polymerase (RNA) II (DNA directed) polypeptide K, 7.0kDa (POLR2K), mRNA [NM_005034] |
| 22 | A_23_P159650 | COX7B | CAAATACGGTAATGCTGTATTAGCTAGTGGAGGCAGTTCTGTA TTGTTACATGGACATA | SEQ ID NO: 1782 | Homo sapiens cytochrome c oxidase subunit VIIb (COX7B), nuclear gene encoding mitochondrial protein, mRNA [NM_001866] |
| 23 | A_23_P162596 | ACTR6 | TTAACGGCTTCACTGGACAGTTTCTTAAGAAGGTAGTTTTGTG TGAGTGTGACTAAAGT | SEQ ID NO: 1787 | Homo sapiens ARP6 actin-related protein 6 homolog (yeast) (ACTR6), mRNA [NM_022496] |
| 24 | A_23_P170233 | CSTA | AAGTGGCTACTGAGTGATGATCCTTGCTGATAAATATAACCATC AATAAAGAAGCATTCT | SEQ ID NO: 1794 | Homo sapiens cystatin A (stefin A) (CSTA), mRNA [NM_005213] |
| 25 | A_23_P18325 | PDCD10 | CCAACCGACTAATTCATCAAAACGAACTTAATACTTCAGACGTTG AAAAGTGTGGCCTGAA | SEQ ID NO: 1795 | Homo sapiens programmed cell death 10 (PDCD10), transcript variant 1, mRNA [NM_007217] |
| 26 | A_23_P19291 | TUBB2A | ACTTCTGAGATCAATGGTGCATCGTAGTGAACTTCTGTTGTCC TCAAGCATGTCTCTGAT | SEQ ID NO: 1798 | Homo sapiens tubulin, beta 2A (TUBB2A), mRNA [NM_001069] |
| 27 | A_23_P200955 | A_23_P200955 | AGACCATGATTGAACCTCAGATTGATGTCAAGATACGGATGGT TATTTGTTTGATCTAC | SEQ ID NO: 1802 | |
| 28 | A_23_P215751 | NDUFA5 | TAAAAGTGGAGTGACTAAATATTTGGAGTAGGTTTCTAATATA AGTGTAGGTGGGTATC | SEQ ID NO: 1831 | Homo sapiens NADH dehydrogenase (ubiquinone) 1 alpha subcomplex, 5, 13kDa (NDUFA5), nuclear gene encoding mitochondrial protein, mRNA [NM_005000] |
| 29 | A_23_P217797 | DDX3Y | CACTGATAGGAAGGTCAGATCCACAAAGTTCTGTCTGAGTTTT GTTATGTTGTTTGGTG | SEQ ID NO: 1836 | Homo sapiens DEAD (Asp-Glu-Ala-Asp) box polypeptide 3, Y-linked (DDX3Y), mRNA [NM_004660] |
| 30 | A_23_P218928 | C4orf18 | CAGAGTAGTTCATTTGCTCTGTGTAGATGTTGTTTCAGAGCTAGG TACAGAGGAATGTTTG | SEQ ID NO: 1837 | Homo sapiens chromosome 4 open reading frame 18 (C4orf18), transcript variant 2, mRNA [NM_016613] |
| 31 | A_23_P252201 | EAF2 | CAGGATTCGTGATAATAGATGGCAGTGATCATAATAGATTCGAGACA ACAGTGGCCTTCTGAT | SEQ ID NO: 1853 | Homo sapiens ELL associated factor 2 (EAF2), mRNA [NM_018456] |
| 32 | A_23_P25235 | CLEC4D | GATTTAACCACCACGAGAGTATTCTGGCATAAGAATGAAACCGAC AACTCTCAGGGAGAA | SEQ ID NO: 1854 | Homo sapiens C-type lectin domain family 4, member D (CLEC4D), mRNA [NM_080387] |
| 33 | A_23_P26021 | COPS2 | TGCTTTTTGATCAACTGGTTGTGTTTGTCTGCTGCATTTATC CCAAGAAAAACAGGTT | SEQ ID NO: 1869 | Homo sapiens COP9 constitutive photomorphogenic homolog subunit 2 (Arabidopsis) (COPS2), mRNA [NM_004236] |
| 34 | A_23_P2705 | P2RY5 | TCTGTATGCTGTTTCCAACTGTGTTGTTTGACCCTATAGTTTAC TACTTTACATCGGACA | SEQ ID NO: 1871 | Homo sapiens purinergic receptor P2Y, G-protein coupled, 5 (P2RY5), mRNA [NM_005767] |
| 35 | A_23_P302550 | RGS18 | GAGTCTAAGGACGCTAGGGATTTGGGGATCTGCCACATTGGTTCA TATTCAGAAAGTGTTA | SEQ ID NO: 1873 | Homo sapiens regulator of G-protein signalling 18 (RGS18), mRNA [NM_130782] |
| 36 | A_23_P307940 | CAPZA2 | CTACAAGATTGGCAAAGAGATGCAGAATGGATAAGAATGAAACATT GGCTGACCGGATCAT | SEQ ID NO: 1876 | Homo sapiens capping protein (actin filament) muscle Z-line, alpha 2 (CAPZA2), mRNA [NM_006136] |
| 37 | A_23_P312246 | CCDC82 | GGGCTTTATAACAGATGACTGTGAAGTGAATGACCTGTTGATATC GTGTCAGTTTAGTCAA | SEQ ID NO: 1880 | Homo sapiens coiled-coil domain containing 82 (CCDC82), mRNA [NM_024725] |
| 38 | A_23_P33045 | RPL26 | TACAAAGGTCAGCAAAATTGGCAAAGTAGTCCAGGTTACAGGAG GAAATATGTTATCTAC | SEQ ID NO: 1890 | Homo sapiens ribosomal protein L26 (RPL26), mRNA [NM_000987] |

Fig. 6-3

| No. | Probe ID No. | Symbols of genes | Sequence | SEQ ID NO: | Descriptions of genes (letters and numbers within [ ] indicates GenBank accession No.) |
|---|---|---|---|---|---|
| 39 | A_23_P339480 | HAT1 | AACATGAACAGCTGGAAGAGAGTTTTCAAGAAGTAGTGGAAGATTACGGGCGTGTTATTG | SEQ ID NO: 1892 | Homo sapiens histone acetyltransferase 1 (HAT1), transcript variant 1, mRNA [NM_003642] |
| 40 | A_23_P347059 | MOBKL1A | CTAGAAGGGAAAAATCATCTAAGTTATGAAATCCAACAATAGCCGCTATATTAGAAACTG | SEQ ID NO: 1896 | Homo sapiens MOB1, Mps One Binder kinase activator-like 1A (yeast) (MOBKL1A), mRNA [NM_173468] |
| 41 | A_23_P41114 | CSTA | AAACAAATGAGACTTATGGAAAATTGGAAGCTGTGTGAGTATAAAACTCAAGTTGTTGCTG | SEQ ID NO: 1925 | Homo sapiens cystatin A (stefin A) (CSTA), mRNA [NM_005213] |
| 42 | A_23_P44257 | COMMD8 | AACATTTTACTTCTGCGCTTCGTCTGTATGTTTGGGAAACAATTGGTCTGATAAAAATAGGTGTC | SEQ ID NO: 1942 | Homo sapiens COMM domain containing 8 (COMMD8), mRNA [NM_017845] |
| 43 | A_23_P501276 | TUBB2A | GTGGACGAGCAGATGTCAACGTGCAGAACAAGAAGAGACAGCTACTTGGTGGAGTGGATC | SEQ ID NO: 1950 | Homo sapiens tubulin, beta 2A (TUBB2A), mRNA [NM_001069] |
| 44 | A_23_P50907 | ITGAV | AAAGAGTGATTAAGTGAGGTTATTACCCCTAAATGGTCATTCTGCATTGTATTTCAGG | SEQ ID NO: 1953 | Homo sapiens integrin, alpha V (vitronectin receptor, alpha polypeptide, antigen CD51) (ITGAV), mRNA [NM_002210] |
| 45 | A_23_P56734 | HNMT | CGTTTTGTCCACCATGGAATATATCGTGACTGCTGTTTATTGGTAATGAAATGGAGACCT | SEQ ID NO: 1962 | Homo sapiens histamine N-methyltransferase (HNMT), transcript variant 1, mRNA [NM_006895] |
| 46 | A_23_P59921 | SUB1 | CAGATTGGGAAATGACGTAGTTGTTCGGGATTTTAAAGGCAAAGTGGCTAATTGAT | SEQ ID NO: 1970 | Homo sapiens SUB1 homolog (S. cerevisiae) (SUB1), mRNA [NM_006713] |
| 47 | A_23_P65768 | C15orf15 | TCCTGCATTGGCATCTACATATATCAGATATATGGGATGTTAGATTGCATGTCAGTGTT | SEQ ID NO: 1977 | Homo sapiens chromosome 15 open reading frame 15 (C15orf15), mRNA [NM_016304] |
| 48 | A_23_P66260 | ZNF267 | TGTATGAATGTGGTAAAGCCTTCAGGTATAGGTCATACGTCACTACACATCGGAGAAGT | SEQ ID NO: 1978 | Homo sapiens zinc finger protein 267 (ZNF267), transcript variant 498723, mRNA [NM_003414] |
| 49 | A_23_P70328 | CENPQ | CAATGGCTTACAGTTTCTGTCTGGTCATCTGGAACTTGAAAATCCTCAAATGCCTTCAC | SEQ ID NO: 1985 | Homo sapiens centromere protein Q (CENPQ), mRNA [NM_018132] |
| 50 | A_23_P7221 | RPL34 | CGAGGACGAGAAAATCGGTTGATGAAAGTGTTGAAGGCACAAGCACAGAGTCAGAAAGCTAA | SEQ ID NO: 1990 | Homo sapiens ribosomal protein L34 (RPL34), transcript variant 2, mRNA [NM_033625] |
| 51 | A_23_P7229 | RPL34 | CGAACCCTGGTTAATAGAATTGTTTACCTTTATACGAAGAAGGTTGGGAAAGCACGAAGA | SEQ ID NO: 1991 | Homo sapiens ribosomal protein L34 (RPL34), transcript variant 2, mRNA [NM_033625] |
| 52 | A_23_P75769 | MS4A4A | CACCAAAGATCAAGCAGCAGACAAATGCTCCAGAAATCTATGGTGACTGTGACACAGAGACCT | SEQ ID NO: 2000 | Homo sapiens membrane-spanning 4-domains, subfamily A, member 4 (MS4A4A), transcript variant 1, mRNA [NM_024021] |
| 53 | A_23_P78092 | EVI2A | GCTGAATCAGAGCACTTGGAAAABAACAAAACAGGTCACAGGACGCAACCTAGTGATGCAA | SEQ ID NO: 2004 | Homo sapiens ecotropic viral integration site 2A (EVI2A), transcript variant 1, mRNA [NM_001003927] |
| 54 | A_23_P83278 | CHMP5 | CATTGCTTCTTTATTTTTCCATTAAGAGAGTCATTGCTTGGGAAATGCTTCGTAC | SEQ ID NO: 2007 | Homo sapiens chromatin modifying protein 5 (CHMP5), mRNA [NM_016410] |
| 55 | A_23_P87879 | CD69 | TGTGCAATATGTGATGTGGGAAGCCCAAGAAATATCTGTATTAGGAAATATTCTGTAATCTTCAGACCTAG | SEQ ID NO: 2011 | Homo sapiens CD69 molecule (CD69), mRNA [NM_001781] |
| 56 | A_23_P94230 | LY96 | TGAAGCTATTTCTGGGAGGAAACCCAGAAATGCTCTTTGGTTGGAGTTTGTCATCCTACA | SEQ ID NO: 2018 | Homo sapiens lymphocyte antigen 96 (LY96), mRNA [NM_015364] |
| 57 | A_23_P94501 | ANXA1 | GGCTGTTTGTTGGGAGGAAAGTAAACATTCCCTTGATGGTCTCAAGCTATGATCAGAAGACT | SEQ ID NO: 2019 | Homo sapiens annexin A1 (ANXA1), mRNA [NM_000700] |

Fig. 6-4

| No. | Probe ID No. | Symbols of genes | Sequence | SEQ ID NO: | Descriptors of genes (letters and numbers within [ ] indicates GenBank accession No.) |
|---|---|---|---|---|---|
| 58 | A_23_P96658 | CYorf15B | ATGCCCTAAAGTTAATACAGCAGTCATATTTTATCAGATGTAAATCTGGATGTAAGGTC | SEQ ID NO: 2023 | lipopolysaccharide-specific response 5-like protein [Source:RefSeq_peptide;Acc:NP_115965] [ENST00000382832] |
| 59 | A_24_P11045 | THC2785765 | CCACCAGAAACGTAGACGTGATTTTCATGACAAATACGGTAGGAACACAAGTCGGAATAG | SEQ ID NO: 2032 | COX7B_HUMAN (P24311) Cytochrome c oxidase polypeptide VIIb, mitochondrial precursor partial (78%) [THC2785765] |
| 60 | A_24_P135551 | LOC130865 | TAACAGGATAGGTGTCCGTGTGGGCATTGACCGAAAGGTGGTTATCACTAGACTAAAACT | SEQ ID NO: 2046 | PREDICTED: Homo sapiens similar to 60S ribosomal protein L26 (Silica-induced gene 20 protein) (SIG-20) (LOC130865), mRNA [XR_019454] |
| 61 | A_24_P144636 | LOC401975 | TGTCGATGTCAAGACTAATGATGGCTACTTCTTTAATCTGTTCTGTGTTGGTTTTACTGA | SEQ ID NO: 2050 | PREDICTED: Homo sapiens similar to ribosomal protein S3a (LOC401975), mRNA [XR_017247] |
| 62 | A_24_P153324 | LOC390413 | GAAGGTTAAGAAGGTTCAATTAACATGCTGGGGATTGTAGAACCATATATTGCAGGGTA | SEQ ID NO: 2054 | PREDICTED: Homo sapiens similar to 60S ribosomal protein L7 (LOC390413), mRNA [XR_018341] |
| 63 | A_24_P188878 | RPL34 | TGTTACGTTTATACCAAGAAGGTTGGGAAAGCAGCAAAATCTGCATGTGGTGTGTGCCC | SEQ ID NO: 2077 | Homo sapiens ribosomal protein L34, mRNA [NM_033625] transcript variant 2, mRNA [NM_033625] |
| 64 | A_24_P201702 | CLEC2B | ATTGGAATTCAAGTAAATAGAACTGTTCACTGCAAACATGCCGAACCTAACTATAATTGACA | SEQ ID NO: 2085 | Homo sapiens C-type lectin domain family 2, member B (CLEC2B), mRNA [NM_005127] |
| 65 | A_24_P203909 | RPL34 | GAGGGGTTCGTGCTGTAAGACTTAAAGTGTTATGAAATTGTCCAAAACAAAGAAACATG | SEQ ID NO: 2088 | Homo sapiens ribosomal protein L34 (RPL34), transcript variant 2, mRNA [NM_033625] |
| 66 | A_24_P221375 | A_24_P221375 | TACTTTGGTTACCCATGTACCTACGGAGTTTGAAAAATCTACAGAGAGTCAATGTCGGAGGA | SEQ ID NO: 2095 | |
| 67 | A_24_P237511 | EIF1AY | GTTTCAGTTACTTAGATGCTCTACATAAGGTTCTGATACAATTTGAAGAGAAATCTGC | SEQ ID NO: 2105 | Homo sapiens eukaryotic translation initiation factor 1A, Y-linked (EIF1AY), mRNA [NM_004681] |
| 68 | A_24_P288604 | LOC731599 | GATGGAAATCATGACGAGAGGTGCGGCAAATGACTTGAAAGAATTGGTCAATAAAATGAT | SEQ ID NO: 2126 | Homo sapiens hypothetical protein LOC731599 (LOC731599), mRNA [XR_015536] |
| 69 | A_24_P303118 | RPL34 | CGAGGACCAGAAAATCGTTGTGAAGATGTTGAAGGCACAAGCACAGAGTCAGAAAGCTAA | SEQ ID NO: 2128 | Homo sapiens ribosomal protein L34 (RPL34), transcript variant 2, mRNA [NM_033625] |
| 70 | A_24_P306527 | ENST00000308989 | ACCGCATCCGGTGCGTGGTTATGCAGAGAAATGTAATGAGGATGAAGATTGACGAAATAAGT | SEQ ID NO: 2132 | PREDICTED: Homo sapiens similar to ribosomal protein L31 (LOC729005), mRNA [XM_001133428] |
| 71 | A_24_P320328 | SUB1 | CAGAAAAAGCTGTAAAGAACAAAAGAGAGGTGAGACTTCGAGAGCCCTGTCATCTTCTA | SEQ ID NO: 2138 | Homo sapiens SUB1 homolog (S. cerevisiae) (SUB1), mRNA [NM_006713] |
| 72 | A_24_P324224 | A_24_P324224 | AAAGCTGTCTGGGCCAAAGGAATAAGGAATTCCTATAGGCATGTGCCGGTTGTCCAGAAAA | SEQ ID NO: 2140 | |
| 73 | A_24_P33213 | A_24_P33213 | GACGATATATTACATGGGGGTACCCAAATCTGAAGTCAGTAAATGAACTTATCTACAAGG | SEQ ID NO: 2143 | |
| 74 | A_24_P333112 | A_24_P333112 | GGTCATCAGAATCAGAGGTATCAATCAATGTGTGAAGCCACAAGGACCAAAAGGTATTGCAACT | SEQ ID NO: 2144 | |
| 75 | A_24_P33607 | LOC652558 | TAAGAAAATAATTGCTTTGGACAGAGAACACGCTTTGATTGCTCGATCTCTTGGTAATATGG | SEQ ID NO: 2145 | PREDICTED: Homo sapiens similar to 60S ribosomal protein L7 (LOC652558), mRNA [XR_019386] |
| 76 | A_24_P349636 | LOC388401 | AGTTGCTTCGACAGATAACACAGTTTGATTGGTGGATCTCTTGGTAAATATAGGATCAAGTG | SEQ ID NO: 2147 | PREDICTED: Homo sapiens similar to 60S ribosomal protein L7 (LOC388401), mRNA [XR_016679] |

Fig. 6-5

| No. | Probe ID No. | Symbols of genes | Sequence | SEQ ID NO: | Descriptions of genes (letters and numbers within [ ] indicates GenBank accession No.) |
|---|---|---|---|---|---|
| 77 | A_24_P366546 | RPL31P10 | CGGGTGTCGAGAAAACGTAATGAGGATGAAGATTCAAATAAGCTCTATACTTTGGTTAGG | SEQ ID NO: 2158 | PREDICTED: Homo sapiens similar to ribosomal protein L31 (LOC390283), mRNA [XR_018695] |
| 78 | A_24_P367191 | LOC652890 | AGTTAACATGCTGAGGACTGTAGAGCCATATATTGCCTGTGGGTACCGAAATCTGAAGTC | SEQ ID NO: 2160 | PREDICTED: Homo sapiens similar to 60S ribosomal protein L7 (LOC652890), mRNA [XR_019544] |
| 79 | A_24_P367199 | A_24_P367199 | TCTTATGCTCGAGCGACGACAGTCTGCCAAATCGAGAAGAAGGTGTAATCATGACCTGAGA | SEQ ID NO: 2161 | |
| 80 | A_24_P381625 | PSMC6 | ATGAAAGCAGTCAGAAAAGTGGCTGATTGTAAGAAGCTGGAGTGTAAATTGGAGTACAAA | SEQ ID NO: 2173 | Homo sapiens proteasome (prosome, macropain) 26S subunit, ATPase, 6 (PSMC6), mRNA [NM_002806] |
| 81 | A_24_P383999 | RPS3A | TGGTTTTACTAAAAACGGAACAATGAGATACAGAAGAGCCTCTATGCCCAGCACCAAGG | SEQ ID NO: 2175 | Homo sapiens ribosomal protein S3A (RPS3A), mRNA [NM_001006] |
| 82 | A_24_P384411 | A_24_P384411 | ATGGCAAAATCAATAAGAGTGAAGGTTTGACAGATAATGCTTTGACACGCTCGATCTGTG | SEQ ID NO: 2176 | |
| 83 | A_24_P392900 | A_24_P392900 | GTCTGTTCTGTGTTGGTTTTCCTAAAAACAATGTAACAATCCGAAAAACGTTTTATGTC | SEQ ID NO: 2180 | |
| 84 | A_24_P414556 | TTC33 | TACTCAACATTTGGTATATTGTTTGAGTAATGAATGGATGTTTGCTTTTTGTGTAATTTGTGA | SEQ ID NO: 2191 | Homo sapiens tetratricopeptide repeat domain 33 (TTC33), mRNA [NM_012382] |
| 85 | A_24_P41551 | LOC641790 | AAGGAGAATGGGAACTCCTGATGTGCCATTGATATGAGGCACAACAAAGTAGTCGGAAA | SEQ ID NO: 2193 | PREDICTED: Homo sapiens similar to ribosomal protein L31 (LOC641790), mRNA [XR_018025] |
| 86 | A_24_P50437 | BC065737 | TGCAGAATGATGAAGTTGGCATTAGAAAAATTCCTGATTAGTGAAGATGTTCAGGGCAAAA | SEQ ID NO: 2198 | Homo sapiens cDNA clone IMAGE:30404477, partial cds. [BC065737] |
| 87 | A_24_P57837 | THC2567891 | ACAAATCCGGAAGACGTCTTATCTCAGTACGAGCCAAATCCGGAAGAAGATGAGAA | SEQ ID NO: 2207 | Q6NXR8_HUMAN (Q6NXR8) Ribosomal protein S3a, partial (91%) [THC2567891] |
| 88 | A_24_P606663 | LOC392030 | TGTGCGGTTGCCGAGAAAAACGTAATGCTGGGTGAAGATTCACCAAATAAGCTCATAGTTT | SEQ ID NO: 2209 | PREDICTED: Homo sapiens hypothetical LOC392030 (LOC392030), mRNA [XR_018063] |
| 89 | A_24_P63347 | PF4V1 | CTACATATTTACCTTGAATGTAGAATTAGCTGCCAATAAATATTAGTAGCTGTTAAGC | SEQ ID NO: 2213 | Homo sapiens platelet factor 4 variant 1 (PF4V1), mRNA [NM_002620] |
| 90 | A_24_P685729 | A_24_P685729 | TTGAAGCTTATGTTGATGTCAAGACTATCAGTGATTATTGCTTGTCTGTTTTGTGTGG | SEQ ID NO: 2217 | |
| 91 | A_24_P6975 | LOC342994 | GGAAGAGTTCGAGGGGTTCGTGCTGTAAGACGTAAAGTTCTTATGAAATTGTCAAAAGA | SEQ ID NO: 2218 | PREDICTED: Homo sapiens similar to ribosomal protein L34 (LOC342994), mRNA [XM_938484] |
| 92 | A_24_P755605 | A_24_P755605 | ATACAGAAGAGCCTCTTATGCTCAGCACCAAGCAACAAGAGAAAAGTAAAAATGCTGAAGAAGCCCAA | SEQ ID NO: 2223 | |
| 93 | A_24_P792734 | PSMC6 | AGAAACGTTAACGGAGTTAACGTAGTCAAATCAAATGGAATTGATACTCTGCATAGAGTTAAA | SEQ ID NO: 2227 | Homo sapiens proteasome (prosome, macropain) 26S subunit, ATPase, 6 (PSMC6), mRNA [NM_002806] |
| 94 | A_24_P84808 | LOC729449 | GAATTGCTTTGACAGATAACGGCTTTGGATCTCGTTGGAAAATATGGCATCATCTGTATGG | SEQ ID NO: 2233 | PREDICTED: Homo sapiens similar to 60S ribosomal protein L7 (LOC729449), mRNA [XR_015548] |
| 95 | A_24_P941643 | PLCB1 | ATGATGTGCAGTTTTGTGCCTTTAATGTATTTGGCTTGTCTGTTCTTTGTCGAATGTGAAATT | SEQ ID NO: 2247 | Homo sapiens phospholipase C, beta 1 (phosphoinositide-specific) (PLCB1), transcript variant 2, mRNA [NM_182734] |
| 96 | A_32_P107717 | BX100535 | TCTTGTGCACCCAAGATCTGCTCTCTGTTGTTAAATCGTGTTCAGACCTGGTCTAATTGGT | SEQ ID NO: 2255 | BX100535 Soares_testis_NHT Homo sapiens cDNA clone IMAGp998I094457, mRNA sequence [BX100535] |

Fig. 6-6

| No. | Probe ID No. | Symbols of genes | Sequence | SEQ ID NO: | Descriptions of genes (letters and numbers within [ ] indicates GenBank accession No.) |
|---|---|---|---|---|---|
| 97 | A_32_P109653 | THC2669092 | TGTGGTTTGGTATTCGAAGTGGGGTGTTTTTGAGAATGTCTGCACTATGTGTGAGATGCAA | SEQ ID NO: 2257 | |
| 98 | A_32_P113154 | LOC730861 | ACCACCAGTCCAAGAGAATCTGTTAAAGTTCAGACTTAAAACAGTACCAAATAAAAAGTCC | SEQ ID NO: 2258 | PREDICTED: Homo sapiens similar to 40S ribosomal protein S3a (v-fos transformation effector protein) (LOC730861), mRNA [XR_015591] |
| 99 | A_32_P114215 | COMMD6 | AATTGCTATCATCTGTAAAGTCATGGACTTGACTTTCGGCAACAAAAGTAATAAGGATGG | SEQ ID NO: 2261 | Homo sapiens COMM domain containing 6 (COMMD6), transcript variant 2, mRNA [NM_203495] |
| 100 | A_32_P125549 | RPL31P4 | TCTACAGACAGTCAATGTGGATGGAGAACTAATCCCTGATCGTCAGATACATCAAATAAAG | SEQ ID NO: 2266 | PREDICTED: Homo sapiens ribosomal protein L31 pseudogene 4 (RPL31P4), mRNA [XR_018222] |
| 101 | A_32_P128781 | A_32_P128781 | CATATATTGGATGGGGGGTACCCCAATCTGAAGTCAGTAAATGAACTAATCTACAAGAGTG | SEQ ID NO: 2268 | |
| 102 | A_32_P135818 | RPS3A | CTTGGTTCATCTGTCTGTGTTGGTTTTAATAAAACGGCAACAATCAGATATGGAAGAC | SEQ ID NO: 2269 | Homo sapiens ribosomal protein S3A (RPS3A), mRNA [NM_001006] |
| 103 | A_32_P145153 | RPL31 | ATCCGTGTGCAGGTGTCCAGAAAAACGTAATGAGGATGAAGATTCACGAAATAAGGCATAT | SEQ ID NO: 2273 | Homo sapiens ribosomal protein L31 (RPL31), mRNA [NM_000993] |
| 104 | A_32_P155364 | RPL7 | TCAAGCAGGCTTATTAGAAAAATGAACCAAGGTGTCTACCATGATTATTTTCTAAGCTGG | SEQ ID NO: 2280 | Homo sapiens ribosomal protein L7 (RPL7), mRNA [NM_000971] |
| 105 | A_32_P164203 | THC2683448 | TTGATGGTCATTGTACGAAGCTATTGTATGGATTACTGTGGACTGCTGTTTACGGAATGAT | SEQ ID NO: 2286 | Q7WZG3_PASP1 (Q7WZG3) Ferric uptake regulator, partial (8%) [THC2683448] |
| 106 | A_32_P178945 | YOD1 | TTGCAAGCATTTTTTGAAGTAATACACTGGTGGTACCTGGAAGATGTCTAAGTTGATTTT | SEQ ID NO: 2296 | Homo sapiens YOD1 OTU deubiquinating enzyme 1 homolog (S. cerevisiae) (YOD1), mRNA [NM_018566] |
| 107 | A_32_P196483 | RPS3A | GGGGCAAAGAAGAAGAAATGGTTGATCCATTTTCTAAGGAAGAATGGTATGATGTGAAGCA | SEQ ID NO: 2306 | Homo sapiens ribosomal protein S3A (RPS3A), mRNA [NM_001006] |
| 108 | A_32_P208178 | RPS3A | GGAAAAGACGTAGAAAAGGCTTGCCAATCTATTTATCCTCTCCATGATGTCTCGTTAGA | SEQ ID NO: 2317 | Homo sapiens ribosomal protein S3A (RPS3A), mRNA [NM_001006] |
| 109 | A_32_P220127 | RPL34 | CAAAACTAGGCTGTGCTGAACCCGTGGTAATAGAATTGTTGACCTTTATACCAAGAAGGT | SEQ ID NO: 2320 | Homo sapiens ribosomal protein L34 (RPL34), transcript variant 2, mRNA [NM_033625] |
| 110 | A_32_P224686 | CAPZA2 | AATTCTGTTTTGAGATTCTGAAATTAAATGAAAATAGTTATTTCAGAAATGCATTTAATG | SEQ ID NO: 2322 | Homo sapiens capping protein (actin filament) muscle Z-line, alpha 2 (CAPZA2), mRNA [NM_006136] |
| 111 | A_32_P2333 | SUB1 | AGGAAGAAAAGGTATTTCTTTAAATCCAGAACAACAGATACGGAAGACCAGGTGACAGAACAGATTTC | SEQ ID NO: 2325 | Homo sapiens SUB1 homolog (S. cerevisiae) (SUB1), mRNA [NM_006713] |
| 112 | A_32_P4532 | LOC643932 | GATTCCAGACAGCATTGGAAAAGACATAGAAAAAGGCTTGCCAATCTATGGTGTCCATGAT | SEQ ID NO: 2332 | PREDICTED: Homo sapiens similar to 40S ribosomal protein S3a (v-fos transformation effector protein) (LOC643932), mRNA [XR_017289] |
| 113 | A_32_P49392 | A_32_P49392 | AATTCTGCCAAATGTGGAAGAAGATGATGGAAATGATGACCAAGAGGTGCAGACAAATG | SEQ ID NO: 2334 | |
| 114 | A_32_P58074 | RPS3A | GTTGTTTACTAAAAAACGCAAAATCAGAATACGGAAGACCTCTTATGCTCAGACCAA | SEQ ID NO: 2336 | Homo sapiens ribosomal protein S3A (RPS3A), mRNA [NM_001006] |
| 115 | A_32_P7118 | PSMC6 | AGGAGACCTGAGAAATGTTTGTACTGAAGCAGGTATGTTGGAATTCGTGCTGATCATGA | SEQ ID NO: 2339 | Homo sapiens proteasome (prosome, macropain) 26S subunit, ATPase, 6 (PSMC6), mRNA [NM_002806] |

Fig. 6-7

| No | Probe ID No. | Symbols of genes | Sequence | SEQ ID NO: | Descriptions of genes (letters and numbers within [ ] indicates GenBank accession No.) |
|---|---|---|---|---|---|
| 116 | A_32_P73222 | AA631847 | TTTCTTTGTTTTGGACAATCTCATAAGAAGTTTAGGTGTTACAG CACGAACGCCTCGAAG | SEQ ID NO: 2340 | np61b02.s1 NCI_CGAP_CGAP_Br2 Homo sapiens cDNA clone IMAGE:1130763 3' similar to TR:G971838 G971838 60S RIBOSOMAL PROTEIN L34 ;. mRNA sequence [AA631847] |

Fig. 7-1

| No. | Probe ID No. | Symbols of genes | Sequence | SEQ ID NO: | Descriptions of genes (letters and numbers within [ ] indicates GenBank accession No.) |
|---|---|---|---|---|---|
| 1 | A_23_P105803 | FGF9 | GAAAAGGACTGCAGCGTGATGACGTGGAAAAAGACACGGTTTT CATTCTGATCAGTT | SEQ ID NO: 2353 | Homo sapiens fibroblast growth factor 9 (glia-activating factor) (FGF9), mRNA [NM_002010] |
| 2 | A_23_P123172 | OR2A9P | CAGGCCTCAGTTGTCACGTTGGACTCGTTGATGCCAATTATTGCCTC AATCCAGAAAAGTTT | SEQ ID NO: 2354 | Homo sapiens olfactory receptor, family 2, subfamily A, member 9 pseudogene (OR2A9P) on chromosome 7 [NR_002157] |
| 3 | A_23_P153676 | TLE2 | CGTCCTCAGTCCTGAGTGTGACATCCAGAAATAACAAATACA TTGTGACAGGCTCGG | SEQ ID NO: 2355 | Homo sapiens transducin-like enhancer of split 2 (E(sp1) homolog, Drosophila) (TLE2), mRNA [NM_003260] |
| 4 | A_23_P157299 | AEBP1 | ACAGTAGAGACCTACACAGTGAACTTTGGGGAGTTCTGAGATCAG GGTCCTACGAAGACC | SEQ ID NO: 2356 | Homo sapiens AE binding protein 1 (AEBP1), mRNA [NM_001129] |
| 5 | A_23_P159907 | MAGED4 | GGAGGCTGTGGATGATGCTTCAAGAGAATGGATGTGGATTGGC CGAGGAACATGCCAG | SEQ ID NO: 2357 | Homo sapiens melanoma antigen family D, 4 (MAGED4), transcript variant 1, mRNA [NM_030801] |
| 6 | A_23_P166280 | THC2614148 | CTCAGGGAGTCTCAGGTTGGAGCGTTATCTCCCAGAATCCTG GAACCTGCTCCTTCT | SEQ ID NO: 2358 | Q59G86_HUMAN (Q59G86) Androgen-regulated short-chain dehydrogenase/reductase 1 variant (Fragment), partial (7%) [THC2614148] |
| 7 | A_23_P166371 | VPREB3 | TGCCCCTCGATATCTCCTCTACTACCGCTCGGAGGAGGATCACCA CCCGGGCCTGGCTGACAT | SEQ ID NO: 2359 | Homo sapiens pre-B lymphocyte gene 3 (VPREB3), mRNA [NM_013378] |
| 8 | A_23_P200015 | AK5 | AATCGAGAGGGAACACCAGAGGACGTTTTTCTTCAACTGTCACA GCTATTGACTCTATT | SEQ ID NO: 2360 | Homo sapiens adenylate kinase 5 (AK5), transcript variant 1, mRNA [NM_174858] |
| 9 | A_23_P202520 | ABLIM1 | TCACTGCACTCCTTCTGTCATAATACTCTGCATCACTCTCTCATACTGA CAACTTCGTGAATAA | SEQ ID NO: 2361 | Homo sapiens actin binding LIM protein 1 (ABLIM1), transcript variant 3, mRNA [NM_001003408] |
| 10 | A_23_P202881 | FEZ1 | TGCTGACAAACATTCTCTTTGCCATGAAGGAGGATAATGAGAAGG TGCCTACTTTGCTAA | SEQ ID NO: 2362 | Homo sapiens fasciculation and elongation protein zeta 1 (zygin I) (FEZ1), transcript variant 1, mRNA [NM_005103] |
| 11 | A_23_P209055 | CD22 | GCCCTCAGGGACAAGAAATGTGGACTATGTGATCCTCAAACATTG ACACTGGATGGGCTG | SEQ ID NO: 2363 | Homo sapiens CD22 molecule (CD22), mRNA [NM_001771] |
| 12 | A_23_P21495 | FCGBP | TCAGTCACCAGGAACGGAACGAAGATTTCCTGAAGAAGACCTGGTC CCTCTGAGGTTGCG | SEQ ID NO: 2364 | Homo sapiens Fc fragment of IgG binding protein (FCGBP), mRNA [NM_003890] |
| 13 | A_23_P256212 | DKFZp761P0423 | GAACTGAATGCAGGCTGGACACTGGCCTCAATACCTTGTTTAGGA TTTCTTGACCCTTT | SEQ ID NO: 2365 | Tyrosine-protein kinase SgK223 (EC 2.7.10.2) (Sugen kinase 223). [Source:Uniprot/SWISSPROT;Acc:Q86YV5] [ENST00000330777] |
| 14 | A_23_P25060 | FLJ13769 | CAGAGTCTTGGAGGATTCTGAGGTAGAGAGTAGGATAATCTCAT TTGTGTTTTATTCT | SEQ ID NO: 2366 | Homo sapiens cDNA FLJ13769 fis, clone PLACE4000222. [AK023831] |
| 15 | A_23_P255896 | ENST00000335459 | GCAAGGGGCTCTACGGAGACTACCTCTTCAATGCTATTGCCGGAA ACTAGGGAGCAAGA | SEQ ID NO: 2367 | Homo sapiens hypothetical protein LOC129293, mRNA (cDNA clone IMAGE:5762496), partial cds. [BC051789] |
| 16 | A_23_P30634 | BACH2 | CCCTCTGTACCTCTGATAAGTGGTCAACGACTGTAACAGGTTACA TGAGGTGTTTTCTA | SEQ ID NO: 2368 | Homo sapiens BTB and CNC homology 1, basic leucine zipper transcription factor 2 (BACH2), mRNA [NM_021813] |
| 17 | A_23_P315378 | ATG16L1 | GTGTGTTTCCAGTTTATACTCTTTGTCCAAAACTCAGTTTCAAAA TATTTGAATGGGAC | SEQ ID NO: 2369 | Homo sapiens cDNA FLJ10035 fis, clone HEMBA1000919. [AK000897] |

Fig. 7-2

| No. | Probe ID No. | Symbols of genes | Sequence | SEQ ID NO: | Descriptions of genes (letters and numbers within [ ] indicates GenBank accession No.) |
|---|---|---|---|---|---|
| 18 | A_23_P316472 | DNHD1 | TAAGCTGCAGAGCAGGAACATGGTGATGGCATCTGGCTTTACCCACCAAGCTCACCGCCAA | SEQ ID NO: 2370 | Homo sapiens dynein heavy chain domain 1 (DNHD1), mRNA [NM_144666] |
| 19 | A_23_P329212 | ETS1 | GTCAACCGCAGGCTATCCAGAATCGGGACTATACCGTAGGATTACTTCATTAGCTATGGTATT | SEQ ID NO: 2371 | Homo sapiens v-ets erythroblastosis virus E26 oncogene homolog 1 (avian) (ETS1), mRNA [NM_005238] |
| 20 | A_23_P329375 | POU6F1 | GTTCCTTTGGCGGGAAAATTGGACTAAAACAGAACCTTTTCTTAATGCATGTTGGAAGGA | SEQ ID NO: 2372 | Homo sapiens POU domain, class 6, transcription factor 1 (POU6F1), mRNA [NM_002702] |
| 21 | A_23_P341938 | NOG | GCCAGCGGTTGCGGCTGGATTCCATCCAGTACCCCATCATTTCCGAGTGCAAGTGCTCGT | SEQ ID NO: 2373 | Homo sapiens noggin (NOG), mRNA [NM_005450] |
| 22 | A_23_P343398 | CCR7 | AAGAGAGCAACATTTACCCACACAGAGATAAAGTTTCCGTTGAGGAAACGAACAGGTTT | SEQ ID NO: 2374 | Homo sapiens chemokine (C-C motif) receptor 7 (CCR7), mRNA [NM_001838] |
| 23 | A_23_P344531 | SYNPO | TCCTGCTGCTGTGAAGATGAAGAAGGTGCTCTTACTCAGTAATGATGAGTGACTATATT | SEQ ID NO: 2375 | Synaptopodin. [Source:Uniprot/SWISSPROT;Acc:Q8N3V7] [ENST00000307662] |
| 24 | A_23_P344884 | KIAA1394 | ACCCAAATTCTAGGATAGGCTGTGAAGCGCTGGAAAACTTGGTGCATCCAACCTGCCTC | SEQ ID NO: 2376 | Homo sapiens KIAA1394 protein, mRNA (cDNA clone IMAGE:4310128), complete cds. [BC036557] |
| 25 | A_23_P356581 | ROBO3 | GGGCTAGCTGAAGCCCATTGGTCTTCCAGGATTGTTCAATTGGCATTTGGCTGAGAAGGCAAGGAGCTAG | SEQ ID NO: 2377 | Homo sapiens roundabout, axon guidance receptor, homolog 3 (Drosophila) (ROBO3), mRNA [NM_022370] |
| 26 | A_23_P357104 | ANXA6 | CTGCTCAACATCCGGAGCATCCGGAGGGAATTCATTGAGAAATATGACAAGTCTCTCCACAAGCCATT | SEQ ID NO: 2378 | Homo sapiens annexin A6 (ANXA6), transcript variant 1, mRNA [NM_001155] |
| 27 | A_23_P357717 | TCL1A | TTTCCCGGGTTTATAGATGGTCAGGCACCTGGGTGTTAGAAAGTTGTATGTGGCATGAAT | SEQ ID NO: 2379 | Homo sapiens T-cell leukemia/lymphoma 1A (TCL1A), mRNA [NM_021966] |
| 28 | A_23_P359870 | C8orf16 | TCGAGGTATAATTTCACTTAACATTGTCGAGTTGGCAGTTGGCATTTTGGTTTAGTCGAATGGT | SEQ ID NO: 2380 | Homo sapiens mRNA for hypothetical protein (C8ORF16) [AJ312026] |
| 29 | A_23_P368996 | LRRC56 | CAAACCAACATTTCCAGCTCTGAGGTGTACAGAAATGGGAGTTTACTTGTAGGCACGTT | SEQ ID NO: 2381 | Homo sapiens leucine rich repeat containing 56 (LRRC56), mRNA [NM_198075] |
| 30 | A_23_P39067 | SPIB | CCTGTCGAAGGTTCCGCTCTTGTCAGATCTGAGATTTCCTAGTTATGTCTGGGGGCCTCTG | SEQ ID NO: 2382 | Homo sapiens Sp-B transcription factor (Spi-1/PU.1 related) (SPIB), mRNA [NM_003121] |
| 31 | A_23_P39356 | FFAR1 | GACCGGTTACTTGGGAAGGGAGTCCTGGGCTGAAGACAGTGTGTGCGGCAAGAAGGCAGG | SEQ ID NO: 2383 | Homo sapiens huntingtin interacting protein 1 related (HIP1R), mRNA [NM_003959] |
| 32 | A_23_P398294 | HIP1R | GTTAGGATTTCCTCCTGAAGTGTTCTTGTTGGCAATAAAATGCACTTTGACTGTTTGTTGT | SEQ ID NO: 2384 | Homo sapiens huntingtin interacting protein 1 related (HIP1R), mRNA [NM_003959] |
| 33 | A_23_P407601 | C8orf6 | GTCTCTCTAGGTTAGTGTAGCGAGGAGATCTATTCTCAGATAAGACTTCCGTGTCGGCTGAA | SEQ ID NO: 2385 | Homo sapiens mRNA for hypothetical protein (C8orf6 gene). [AJ307469] |
| 34 | A_23_P40989 | USP13 | TGAGATGGAGAATAATGCCAATGCAAACATTATTCTGAGGCCAAGCCGAAGGACCTAG | SEQ ID NO: 2386 | Homo sapiens ubiquitin specific peptidase 13 (isopeptidase T-3) (USP13), mRNA [NM_003940] |
| 35 | A_23_P420873 | NR1D1 | CCCTTGTACAGAATCGAACTCTGGACTTCTGTCTCTTACGAGACGAAAAAGCA | SEQ ID NO: 2387 | Homo sapiens nuclear receptor subfamily 1, group D, member 1 (NR1D1), mRNA [NM_021724] |
| 36 | A_23_P46585 | SALL2 | CTAGTAAAATGTCAAGAACAGAGAGGGAGATATTAGTGTCTTTCCCTCTATCATTAAAGGT | SEQ ID NO: 2388 | Homo sapiens sal-like 2 (Drosophila) (SALL2), mRNA [NM_005407] |
| 37 | A_23_P49643 | GRAP | CATCTGCCAGGAAGGTTGAGGACTCCCAGGTTTCACCCACTGGAGGCTCAACCTAAGGAA | SEQ ID NO: 2389 | Homo sapiens GRB2-related adaptor protein (GRAP), mRNA [NM_006613] |

Fig. 7-3

| No. | Probe ID No. | Symbols of genes | Sequence | SEQ ID NO: | Descriptions of genes (letters and numbers within [ ] indicate GenBank accession No.) |
|---|---|---|---|---|---|
| 38 | A_23_P57236 | GGTL3 | CGAAGGACGAACAACTTGATGATCGCTGTGTTAAGGACCCTCGGAGCCCAGATGAGCTGGA | SEQ ID NO: 2390 | Homo sapiens gamma-glutamyltransferase-like 3 (GGTL3), mRNA [NM_178026] |
| 39 | A_23_P83388 | EPPK1 | GTTTTTGGTCGTCGTTTCTGGGTCGTCGTTGTATGTCATGATGGTTTAGTTTGTCCGGGAA | SEQ ID NO: 2391 | Homo sapiens epiplakin 1 (EPPK1), mRNA [NM_031308] |
| 40 | A_23_P65269 | TTN | CTGACAACCTGATCATGATCATGGACGTACAGAAACAAGATGGTGGACTTTATACCGTCACT | SEQ ID NO: 2392 | Homo sapiens titin (TTN), transcript variant N2-A, mRNA [NM_133378] |
| 41 | A_23_P88222 | PLD4 | TGAAAGTCTCATCGGTGCCGGTGGGGAGCCATTCCAACATCCCATTCAGCAGGGTGAACC | SEQ ID NO: 2393 | Homo sapiens phospholipase D family, member 4 (PLD4), mRNA [NM_138790] |
| 42 | A_24_P102512 | CABIN1 | CTCCTGTGGGTGATATTTCTGGGGGAGGAGATAAATCCAAGAAAGGGTAAAACGGAAGAAGA | SEQ ID NO: 2394 | Homo sapiens calcineurin binding protein 1 (CABIN1), mRNA [NM_012295] |
| 43 | A_24_P134816 | BCL9L | TGCTCCTACGGAGGAGAGCTCCCTATCGCGCCTTTGGTCAGAGGTGAAGCCATATAGGACT | SEQ ID NO: 2395 | Homo sapiens B-cell CLL/lymphoma 9-like (BCL9L), mRNA [NM_182557] |
| 44 | A_24_P229164 | HIP1R | CGTGAGCGTCAACTCTTCAGAAAATAGTGTTTTTAATATTCCTGTTCAGAAAATAGTGTT | SEQ ID NO: 2396 | Homo sapiens huntingtin interacting protein 1 related (HIP1R), mRNA [NM_003959] |
| 45 | A_24_P298360 | LTBP3 | CTGCTGTTGGGGAAGGGCCAAGAGATGAGGACAGTCAGAGAGGATCAGAGACGAGTGT | SEQ ID NO: 2397 | Homo sapiens latent transforming growth factor beta binding protein 3 (LTBP3), mRNA [NM_021070] |
| 46 | A_24_P302506 | AMIGO1 | AATTGGAGAATTGAATAATCAGGACATATGTAAGCGCGACTAGAACCCTGTGTTGAAAACTAC | SEQ ID NO: 2398 | Amphoterin-induced protein 1 precursor (AMIGO-1) (Alivin-2). [Source:Uniprot/SWISSPROT;Acc:Q86WK6] [ENST00000369864] |
| 47 | A_24_P312325 | C8orf15 | CTTGTTCAATGTGACTACTTAGTTGCCTGTCCAATATGAAGTAGAAAGCAGATTTCTG | SEQ ID NO: 2399 | Homo sapiens chromosome 8 open reading frame 15 (C8orf15), mRNA [NM_001033662] |
| 48 | A_24_P324638 | IGHD | AGATGGTGCAGTGGTTAGAGCTGAGGCTTATCGGACAGAGAACCGTGGCGCCTTGGTCAA | SEQ ID NO: 2400 | Homo sapiens mRNA for FLJ00382 protein. [AK090461] |
| 49 | A_24_P354715 | NT5E | TCGCCTCCAAATCTGAAGACTGAAGACGTCAGTGTAAATCATTGTTAAGCCCAGATATGAGAACTTC | SEQ ID NO: 2401 | Homo sapiens 5'-nucleotidase, ecto (CD73) (NT5E), mRNA [NM_002526] |
| 50 | A_24_P37020 | THC2680931 | TGGTTCTACGTCGAACTAAAGAGGAAGAGAGGAGGTGAAGGTGACGCCATGTTAGGCTATGAGA | SEQ ID NO: 2402 | AF235005 suppression of tumorigenicity 16 protein [Homo sapiens] (exp=-1; wgp=0; cg=0), partial (13%) [THC2680931] |
| 51 | A_24_P385012 | BC030084 | TCCGGCGTCATGTGTTGGGTGAAATACTGTTTATGCTTAGTACTAAAATTAAAAGTTAC | SEQ ID NO: 2403 | Homo sapiens cDNA clone IMAGE:4791887. [BC030084] |
| 52 | A_24_P413126 | TMEPAI | AAGAAAGTGCTTGTTGTGTATCAGTAATCATTAGTGGGAATGATGACATTCTGAAAAGCT | SEQ ID NO: 2404 | Homo sapiens transmembrane, prostate androgen induced RNA (TMEPAI), transcript variant 1, mRNA [NM_020182] |
| 53 | A_24_P419028 | MOP-1 | ACCCCCTCACTTTTCAGACCTATAGTTGTCGTTTGATTGTCCAGTTAAAACTACAA | SEQ ID NO: 2405 | Homo sapiens mRNA for MOP-1, complete cds. [AB014711] |
| 54 | A_24_P525144 | A_24_P525144 | GATGATGACAACCTCTATTGGGGATTGGCACCTTGTCGAACCTTCCTATCAAATATTCTT | SEQ ID NO: 2406 | |
| 55 | A_24_P62505 | GLT25D2 | AGGATTTTAGACTAGGACTGTTCTACTGTGAAGAAAAGTTCTCTCTCCTTAGCCCGGTTT | SEQ ID NO: 2407 | Homo sapiens glycosyltransferase 25 domain containing 2 (GLT25D2), mRNA [NM_015101] |
| 56 | A_24_P662177 | THC2666469 | GGGACAGGTAGGATTTCAATGGGCATGTTAGATAACATGCTCTCAGGGACAAGAATGTACA | SEQ ID NO: 2408 | |
| 57 | A_24_P8257 | BC009036 | CTCCGGTACATGAAAGTAAGCCTGAAGAGTCAGGTCGTCGTCGTCGTCTCGATTTTTCTGAAGATTTT | SEQ ID NO: 2409 | Homo sapiens cDNA clone IMAGE:4155841, partial cds. [BC009036] |

Fig. 7-4

| No. | Probe ID No. | Symbols of genes | Sequence | SEQ ID NO: | Descriptions of genes (letters and numbers w/b[s ] indicate GenBank accession No.) |
|---|---|---|---|---|---|
| 58 | A_24_P910490 | BX099367 | AGGCCCAGAGTTGAGAGACCACCTTGGGCTACACAGTGACAGCCTGTCTGTAGAAAAACTA | SEQ ID NO: 2410 | BX099367 Soares_fetal_liver_spleen_1NFLS_S1 Homo sapiens cDNA clone IMAGp998G05977, mRNA sequence [BX099367] |
| 59 | A_24_P922909 | AF272377 | AAGAAAAAGCAGCCTCCACCACCACAGAAATCAGGTGTAGAGCGGAAGCTGGAGTGGTGGCCT | SEQ ID NO: 2411 | Homo sapiens clone 1370-48 MLL protein mRNA, partial cds. [AF272377] |
| 60 | A_24_P924462 | PRKCZ | GCATGAGAGTGAAAGATGATATTTTAATTCTATCATTGAGGCATAGTCTTTCGAACACACC | SEQ ID NO: 2412 | Homo sapiens mRNA, chromosome 1 specific transcript KIAA0505. [AB007974] |
| 61 | A_24_P930963 | LOC650392 | GCCCCATTTCAAGTATAAGCAGGGGAAAATGGTGCTTGAAATAAGCATGCCACAAAGG | SEQ ID NO: 2413 | Homo sapiens cDNA clone IMAGE:5264670. [BC036550] |
| 62 | A_24_P933482 | ZDHHC21 | GCGAGCCAGGGGCGAGAATGAAGAACTTTCACTTACTGCAGGATTTTCAAGCTGAGC | SEQ ID NO: 2414 | Homo sapiens zinc finger, DHHC-type containing 21 (ZDHHC21), mRNA [NM_178566] |
| 63 | A_24_P940348 | FAM129C | AGACAAGCTTTTACCGACTTCCTCTCTTGCCAGCAAAGTCATCTGGTAAGTGGATATTG | SEQ ID NO: 2415 | Homo sapiens family with sequence similarity 129, member C (FAM129C), mRNA [NM_173544] |
| 64 | A_24_P943263 | RASA4 | TCCTCGATAGTCTATCTTTTGTATATCTTTGAACTTTTCAAGAATAAAAAAGTTAAAAAG | SEQ ID NO: 2416 | Homo sapiens RAS p21 protein activator 4 (RASA4), transcript variant 1, mRNA [NM_006989] |
| 65 | A_24_P945396 | SF3B3 | ATCCAGTTTGTGGATCCAATTGAGAAAACATTTCATGAGACAACTACTTGTGGCATGCAT | SEQ ID NO: 2417 | Homo sapiens KIAA0017 mRNA, complete cds. [D13642] |
| 66 | A_32_P111394 | THC2643957 | GAATACAGTGTTCCTTTTCGTTTGCTTTAGGCTTTTGAATGAAAGTGAGATGTCTACATCAATTATAAGG | SEQ ID NO: 2418 | |
| 67 | A_32_P125589 | THC2643941 | GGCTGTATCCCCTTGCTTTAGGCTTTTCCTTAATTAGAGGTAGTCTGGGAAACATGAGCTCAGATAG | SEQ ID NO: 2419 | |
| 68 | A_32_P131294 | BM854107 | AGTTAGGCAAAAAGACTTTGTTGTTCCTTAATTAGAGGTAGTCTGGGAAATGCTAGGACTTGTGC | SEQ ID NO: 2420 | K-EST0136406 S22SNU16n1 Homo sapiens cDNA clone S22SNU16n1-145-F11 5', mRNA sequence [BM854107] |
| 69 | A_32_P133767 | C12orf42 | AAGGGCCTCAGATGTAGTGGTTCCACAGAACCATTGTTAGGGTTTTGTGAAGCATTTT | SEQ ID NO: 2421 | Homo sapiens chromosome 12 open reading frame 42 (C12orf42), mRNA [NM_198521] |
| 70 | A_32_P145764 | BC043547 | GGTCCCGTCCCTCTGTGTAACCAATAACGAATGCCATATAAATGGAAAGTATAAAGAA | SEQ ID NO: 2422 | Homo sapiens, clone IMAGE:5171873, mRNA. [BC043547] |
| 71 | A_32_P146659 | LOC401431 | AGGTGTGATGCAGTAGCTTTACTATTGGTGCAAATGATGTTTTTCCTTGAAAGTCTA | SEQ ID NO: 2423 | Homo sapiens hypothetical gene LOC401431 (LOC401431), mRNA 001008745] |
| 72 | A_32_P146844 | THC2639619 | CCTGTGTGGCGTGATTCGAGACTGAGAGTTGAAGTTTTGTGTGCATCATCATGTGCCATTAA | SEQ ID NO: 2424 | |
| 73 | A_32_P15829 | AW389914 | TGATCTCCAAGGTTCTGACCTCTGAGAGTGACGTTAAGTGCAGAGAGCCACACAGTACA | SEQ ID NO: 2425 | AW389914 RC4-ST0173-191099-032-f06 ST0173 Homo sapiens cDNA, mRNA sequence [AW389914] |
| 74 | A_32_P154378 | THC2703271 | GAAAGAACGTAGAAAAGCATTGGAATGAAGGAAAGCCACCTGGTTTAGAGTTTAATTTG | SEQ ID NO: 2426 | |
| 75 | A_32_P164573 | THC2611661 | AGCTGTTTTCTATTAACACTGAAGTACTCTGACAGCTTGGAAATTTTCAAGTGCAAAATC | SEQ ID NO: 2427 | RR12_SPINX (P42344) Chloroplast 30S ribosomal protein S12, partial (11%) [THC2611661] |
| 76 | A_32_P168222 | THC2673977 | GATAGGGTCTGAGGGACAGAAAAGCAGCATAGTCCAATTTAGTTTCTCAAAACACATAG | SEQ ID NO: 2428 | ALU1_HUMAN (P39188) Alu subfamily J sequence contamination warning entry, partial (14%) [THC2673977] |
| 77 | A_32_P170397 | ENST00000309874 | CTGTTTGGCACGACTGATTCAGGGCCCTGGTGAAATGAGAACCCTGTGCGTGGGAACAA | SEQ ID NO: 2429 | Homo sapiens cDNA FLJ33063 fis, clone TRACH2000047. [AK057625] |

Fig. 7-5

| No. | Probe ID No. | Symbols of genes | Sequence | SEQ ID NO: | Descriptions of genes (letters and numbers within [ ] indicates GenBank accession No.) |
|---|---|---|---|---|---|
| 78 | A_32_P179998 | DMRTC1 | ATATGCCAAGAGTTTTATTCGTCTTGTTGATTGGTGAGATACCTGT GGACTCATGTGTATA | SEQ ID NO: 2430 | Homo sapiens DMRT-like family C1 (DMRTC1), mRNA [NM_033053] |
| 79 | A_32_P184039 | A_32_P184039 | ATCATTGTTAGTCTTGGCCCAAAAATAGTTGTTGTATGTATCATGCG TAATAACTGACCAGC | SEQ ID NO: 2431 | |
| 80 | A_32_P190682 | THC2739159 | TCAATAGGTTTTTATTTGCTCCGGTTTACCTAGATGAGAAAATTGAG ACCCAGAATCCATGC | SEQ ID NO: 2432 | ALU8_HUMAN (P39195) Alu subfamily SX sequence contamination warning entry, partial (8%) [THC2739159] |
| 81 | A_32_P196287 | THC2652466 | CCTTTCACAAAGACTGTAAGGCTTACGCAAGCATTAATTTTGCTG CATAGGCGGCCTGTT | SEQ ID NO: 2433 | Q9BHM3_PARTE (Q9BHM3) Cyclophilin-RNA interacting protein, partial (4%) [THC2652466] |
| 82 | A_32_P209582 | THC2663167 | CAATGTAAAGCCAGAATATCAACGTCGTTTTTGTCAAGATTTTCAA ACCTATTTGGCTGAT | SEQ ID NO: 2434 | ALU7_HUMAN (P39188) Alu subfamily J sequence contamination warning entry, partial (5%) [THC2663167] |
| 83 | A_32_P32254 | COL6A1 | ATATGCATGTGTTCGACGTTTATCAAAAGGCCGCCTTCTATGTT CATGTTAGTTTTTGCT | SEQ ID NO: 2435 | Homo sapiens collagen, type VI, alpha 1 (COL6A1), mRNA [NM_001848] |
| 84 | A_32_P3342 | THC2676548 | TATAGCATTTTCTGAAGATCATGTTGTACTCTCTTCTTCGTCTAGA TGATTTTGGTCAAGAG | SEQ ID NO: 2436 | ALU7_HUMAN (P39194) Alu subfamily SQ sequence contamination warning entry, partial (19%) [THC2676548] |
| 85 | A_32_P356316 | HLA-DOA | TGGAAAGGTTTTCTCCATCTCTGTCCTAAGGCTTGATAAAGTC ATTAAAATTGTGTTC | SEQ ID NO: 2437 | Homo sapiens major histocompatibility complex, class II, DO alpha (HLA-DOA), mRNA [NM_002119] |
| 86 | A_32_P40673 | A_32_P40673 | CATCACACTTGATATTAGGACAGGCTACCTACTTGTTGAGTGTC ACAGCCTGATATGTA | SEQ ID NO: 2438 | |
| 87 | A_32_P62371 | THC2674900 | GTGTTGCCTGAAAGTATTTCTCAGTCTTTCAGTGAAAACAGTGGAA CTGACTGATCTGGTC | SEQ ID NO: 2439 | |
| 88 | A_32_P71171 | A_32_P71171 | TCTAGATAGTAATAGGAAACCAAGAATCCAAGCCTGGTGATGGCTC GAGGGAGTGATTGAA | SEQ ID NO: 2440 | |
| 89 | A_32_P79103 | BM932034 | GTGCTACAGATGAAAATAGCCATTTTAGGAAGGTTGAGTCAGAGAC TGCGAGTGGGGCATA | SEQ ID NO: 2441 | UI-E-EJ1-aji-k-24-0-UI.r1 UI-E-EJ1 Homo sapiens cDNA clone UI-E-EJ1-aji-k-24-0-UI 5', mRNA sequence [BM932034] |
| 90 | A_32_P82111 | LRFN2 | ATGCCGGACTGAGCGCCTGAGTGTTTGGAAAGGGAGACTCCGCCT TTCTAATCACAAATG | SEQ ID NO: 2442 | Homo sapiens leucine rich repeat and fibronectin type III domain containing 2 (LRFN2), mRNA [NM_020737] |
| 91 | A_32_P88987 | AK022346 | ATGGGAAGTTACTACCCAGGCTTACCAAAAGGTCAGGTTTATATA AAGTGGGGTCCTTT | SEQ ID NO: 2443 | Homo sapiens cDNA FLJ12284 fis, clone MAMMA1001757. [AK022346] |
| 92 | A_32_P90346 | THC2682291 | TACAGGGATTAGATCCGAGGCGACATTACGCATACGTCAGAAT GGTCTGTCGGGAACA | SEQ ID NO: 2444 | |
| 93 | A_32_P90468 | A_32_P90468 | AAGCCAGGAATAATTTTTCTATGTCATGCTAGCTAACTCCTGGAAG TTATCATGAGACCCT | SEQ ID NO: 2445 | |
| 94 | A_32_P91328 | THC2641695 | GTTAGGGGAATAATGTCATTGAAGTCTTTAACTCTAGCGTGACTC TAAGGCCAGGGTTCA | SEQ ID NO: 2446 | |
| 95 | A_32_P91743 | THC2724606 | TTCAAAGGATTCTCCAAGCATCAGTGATTCTCAAAGATTAAGAG CCACTAATTTAAGCC | SEQ ID NO: 2447 | Q96HL9_HUMAN (Q96HL9) CHP protein, partial (39%) [THC2724906] |
| 96 | A_32_P98840 | THC2745859 | AAAGTATTCCAAGATAGCAAAGGTGTTGTTTTTAGCAGGTG TATTTCAGCTAGTTA | SEQ ID NO: 2448 | |

Fig. 7-6

| No. | Probe ID No. | Symbols of genes | Sequence | SEQ ID NO: | Descriptions of genes (letters and numbers within [ ] indicate GenBank accession No.) |
|---|---|---|---|---|---|
| 97 | A_23_P102060 | SSFA2 | GTATCATCCAAATAATGGGGCCTATGACTTGAATGAATAGAAATG AATAAGCTGGTGTTT | SEQ ID NO: 2449 | Homo sapiens sperm specific antigen 2 (SSFA2), mRNA [NM_006751] |
| 98 | A_23_P102160 | FAM82A | GGGTATGTGTCCTTAGATTTGAAGGTAAAGCCATGTTTCTGCAGAA TGGATTCCACTAGTA | SEQ ID NO: 2450 | Homo sapiens unknown mRNA. [AF435956] |
| 99 | A_23_P102235 | SNRPG | ACAACAGAACAATATGGAATGGTAATACGAGGAAATAGTAT CATCATGTTAGAAGC | SEQ ID NO: 2451 | Homo sapiens small nuclear ribonucleoprotein polypeptide G (SNRPG), mRNA [NM_003096] |
| 100 | A_23_P102391 | SLC40A1 | CTCATGTTATCATCATTAGTGATCTGTGTTGTAGAACATGAGGGT GTAAGGCTTCAGCCT | SEQ ID NO: 2452 | Homo sapiens solute carrier family 40 (iron-regulated transporter), member 1 (SLC40A1), mRNA [NM_014585] |
| 101 | A_23_P104054 | C1orf9 | TAAATTTCTTCGTGTCGTGGACAATTAGCTATTCAGAGGAAGAGG GCCTGATTTTATAGA | SEQ ID NO: 2453 | Homo sapiens chromosome 1 open reading frame 9 (C1orf9), transcript variant 2, mRNA [NM_016227] |
| 102 | A_23_P104471 | DUSP13 | GATTTCCGTGACCAATTCAGAGATTCTTTATGCAAAAGTGAGTT CAGTCCATCTCTATA | SEQ ID NO: 2454 | Homo sapiens dual specificity phosphatase 13 (DUSP13), transcript variant 1, mRNA [NM_001007271] |
| 103 | A_23_P107847 | LILRA5 | CCAGTGACCTCCTGGAGATTCCGGTCTCAGGAGGAGGTGATAACC TGAGTCCGTCAGAAA | SEQ ID NO: 2455 | Homo sapiens leukocyte immunoglobulin-like receptor, subfamily A (with TM domain), member 5 (LILRA5), transcript variant 2, mRNA [NM_181985] |
| 104 | A_23_P108394 | THC2783023 | ATTCAGAAACTTGCTTGTGTGATACATAGTAAGTCTCTTCATTT ATTAGTGCTTGTGTG | SEQ ID NO: 2456 | Q81UM9_HUMAN (Q81UM9) ACSL3 protein, complete [THC2467888] |
| 105 | A_23_P110362 | MAP2K1IP1 | ACTGAGACAAGTTGTGGAAGTTTCTTAATCTGACAGTGGTTTCAG TGTGTACGTTATCTT | SEQ ID NO: 2457 | Homo sapiens mitogen-activated protein kinase kinase 1 interacting protein 1 (MAP2K1IP1), mRNA [NM_021970] |
| 106 | A_23_P110611 | ZH2C2 | CTGTTGAAAAGGAGAGTTCAGTCTGTCGTTGGACTCTCAAACCAGG TTCTGAATACTTAA | SEQ ID NO: 2458 | Homo sapiens zinc finger, H2C2 domain containing (ZH2C2), mRNA [NM_017676] |
| 107 | A_23_P111321 | ARG1 | TGAATCAGGAGAGACAAAGCTACGACACATGTGGAAAGGTACTATGTG TCCATGTCATTCAAA | SEQ ID NO: 2459 | Homo sapiens arginase, liver (ARG1), mRNA [NM_000045] |
| 108 | A_23_P111583 | CD36 | GTTTGGCTTTAATGAGACTGGGACCATTGGTGATGAGAAGGCAAAC ATGTTCAGAAGTCAA | SEQ ID NO: 2460 | Homo sapiens CD36 molecule (thrombospondin receptor) (CD36), transcript variant 2, mRNA [NM_001001547] |
| 109 | A_23_P11201 | GPR34 | AGTAGGAGTGAAAGCGACTTCAGAATTTAAACCAGGATACTCCGTG CATGATACATCGTGTG | SEQ ID NO: 2461 | Homo sapiens G protein-coupled receptor 34 (GPR34), transcript variant 1, mRNA [NM_005300] |
| 110 | A_23_P112251 | LOC552891 | AGAATTGTTAAGTTCAGAAGTGTTTTACTTCGACGATGTGCGTTT GATTAATTGGGAC | SEQ ID NO: 2462 | Homo sapiens hypothetical protein LOC552891 (LOC552891), mRNA [NM_004125] |
| 111 | A_23_P113972 | EXOC1 | CGTGGCAGGCAGCATAACGGAGCGAGGAAGTAAGTTACCAACTTGC ATTAACAAACAAGA | SEQ ID NO: 2463 | Homo sapiens exocyst complex component 1 (EXOC1), transcript variant 1, mRNA [NM_018261] |
| 112 | A_23_P114947 | RGS2 | TAGATCTGGGATTATGTGGGCGTTAGGTAGCTGGTTGTACATCGTTT CCCTAAATCGATCGA | SEQ ID NO: 2464 | Homo sapiens regulator of G-protein signalling 2, 24kDa (RGS2), mRNA [NM_002923] |
| 113 | A_23_P11685 | PLA2G4A | GAAATGGCAGCAGTTTCTGATGCTGCAGGCAGTTTGCAATCCGATG ACAACTGGATTTAAA | SEQ ID NO: 2465 | Homo sapiens phospholipase A2, group IVA (cytosolic, calcium-dependent) (PLA2G4A), mRNA [NM_024420] |
| 114 | A_23_P118061 | CKLF | GCACAAGCCCCTGAACCATATATTGTTATCACTGGATTTGAAGTC ACCGTTATCTTATTT | SEQ ID NO: 2466 | Homo sapiens chemokine-like factor (CKLF), transcript variant 4, mRNA [NM_181641] |

Fig. 7-7

| No. | Probe ID No. | Symbols of genes | Sequence | SEQ ID NO: | Descriptions of genes [colons and numbers within [ ] indicates GenBank accession No.] |
|---|---|---|---|---|---|
| 115 | A_23_P118246 | GINS2 | TGTGTGATGGTGCAAGGAATGGATTGAGTGTTGGAGAAAC AAGTTTGTGATTAGT | SEQ ID NO: 2467 | Homo sapiens GINS complex subunit 2 (Psf2 homolog) (GINS2), mRNA [NM_016095] |
| 116 | A_23_P119516 | FAM18B | TATTTCTGTAGAATGTTTCAGGAGAAAGTTTTGCTTCTATGGTA AGAGTGAGCACTTTG | SEQ ID NO: 2468 | Homo sapiens family with sequence similarity 18, member B (FAM18B), mRNA [NM_016079] |
| 117 | A_23_P119222 | RETN | CAATAAGCAGCATTGGCCTGGAGTGCCAGAGGTGCACCTCCAGGG GGGACCTGGCTACTT | SEQ ID NO: 2469 | Homo sapiens resistin (RETN), mRNA [NM_020415] |
| 118 | A_23_P120048 | BAZ2B | TATTTCTGTGAAGGTAATGATAGGTATACAGTCTGTACAGTAA TTATCCTCTACCAAC | SEQ ID NO: 2470 | Homo sapiens bromodomain adjacent to zinc finger domain, 2B (BAZ2B), mRNA [NM_013450] |
| 119 | A_23_P120316 | MTHFD2 | AGGATTATTCCTTGCTATTAGTACTACTGATTTATGTATGTTACCCT TCAGTAAGTTCTCCC | SEQ ID NO: 2471 | Homo sapiens methylenetetrahydrofolate dehydrogenase (NADP+ dependent) 2, methenyltetrahydrofolate cyclohydrolase (MTHFD2), nuclear gene encoding mitochondrial protein, transcript variant 1, mRNA [NM_006636] |
| 120 | A_23_P120345 | PELI1 | CTTGCCACCCTTTTTTCAAAGGGACCACAAGTATAGACAGTGCA CTACATCAAATCTTT | SEQ ID NO: 2472 | Homo sapiens pellino homolog 1 (Drosophila) (PELI1), mRNA [NM_020651] |
| 121 | A_23_P121253 | TNFSF10 | GGAACAATCGATCTCTCAGCTAGTGTATCAGCTAGTAGCCTCCA GGTTTCCTTAAGGGA | SEQ ID NO: 2473 | Homo sapiens tumor necrosis factor (ligand) superfamily, member 10 (TNFSF10), mRNA [NM_003810] |
| 122 | A_23_P121622 | SULT1B1 | GAAATAGAGATTGTCTGTAGTTGATTGAAACGAGGGGCACTTATGA ATTGATTTGGGCAAT | SEQ ID NO: 2474 | Homo sapiens chromosome 5 open reading frame for ST1B2, complete cds. [D89479] |
| 123 | A_23_P121716 | ANXA3 | TGGACATTCGAACAGAGTTCAAGAACGATTATGGCTATTCCGTAT ATTGAGCAATTAAAT | SEQ ID NO: 2475 | Homo sapiens annexin A3 (ANXA3), mRNA [NM_005139] |
| 124 | A_23_P121825 | FLJ13611 | CATGTGTTACTGTTACAAAACTTCTCTCTGTCCATGTAATCAACT TAGTATATGAGCAAAG | SEQ ID NO: 2476 | Homo sapiens hypothetical protein FLJ13611 (FLJ13611), mRNA [NM_024941] |
| 125 | A_23_P122007 | C5orf30 | ATCAGATTTCTCGTTGGGCTGGAACAGTTGGGTGTGTATATTT TAAAGTAAATTGCAC | SEQ ID NO: 2477 | Homo sapiens chromosome 5 open reading frame 30 (C5orf30), mRNA [NM_033217] |
| 126 | A_23_P122174 | XRCC4 | AAACAAAGTGATCTCTCTGGGTTGGCTTCAGCTGCTGTAAGTAA AGATGATTCCATTAT | SEQ ID NO: 2478 | Homo sapiens X-ray repair complementing defective repair in Chinese hamster cells 4 (XRCC4), transcript variant 3, mRNA [NM_022550] |
| 127 | A_23_P122724 | VNN2 | AAAGAGCCTAGGCTGGGTGTTTGGGTCAGAATGAAGATCAAACTCCA GCTCCAGCGTCATTT | SEQ ID NO: 2479 | Homo sapiens vanin 2 (VNN2), transcript variant 1, mRNA [NM_004665] |
| 128 | A_23_P123608 | JAK2 | GGATAACATGGCTGGAATGAAAGAAATGACCTTCATTCTGAGACCA AAGTAGATTTACAGA | SEQ ID NO: 2480 | Homo sapiens Janus kinase 2 (a protein tyrosine kinase) (JAK2), mRNA [NM_004972] |
| 129 | A_23_P123727 | ZCCHC6 | TTGAAGAGGGGAAATTATACTTATTGTTGTTACTGAATGCTCGT GTGAAAAGCATATCAG | SEQ ID NO: 2481 | Homo sapiens zinc finger, CCHC domain containing 6 (ZCCHC6), mRNA [NM_024617] |
| 130 | A_23_P128384 | VPS29 | CAGCTAATTCGAGATGATGTGAAAGTAGAACGAATCGAATACAAA AAACCTTAAAGGCAG | SEQ ID NO: 2482 | Homo sapiens vacuolar protein sorting 29 homolog (S. cerevisiae) (VPS29), transcript variant 2, mRNA [NM_057180] |
| 131 | A_23_P128447 | LRRK2 | GCAGAAAGAGATAGCAATCTTGCTTGGACCGTTTGGGACATCGAATCT TCCACATGAAGTGCA | SEQ ID NO: 2483 | Homo sapiens leucine-rich repeat kinase 2 (LRRK2), mRNA [NM_198578] |
| 132 | A_23_P128930 | PSMC6 | GAACAAGCAAGATTAGACATACTGAAAATGCAGGTCCCATT ACAAAGCATGGTGAA | SEQ ID NO: 2484 | Homo sapiens proteasome (prosome, macropain) 26S subunit, ATPase, 6 (PSMC6), mRNA [NM_002806] |

Fig. 7-8

| No. | Probe ID No. | Symbols of genes | Sequence | SEQ ID NO: | Descriptions of genes (letters and numbers within [ ] indicates GenBank accession No.) |
|---|---|---|---|---|---|
| 133 | A_23_P129940 | C14orf138 | TTGGTATTGAGGCGAGGCTGAAATCTGCCAAAAACAGCCAACATG ATTTGACTGGACCTT | SEQ ID NO: 2485 | Homo sapiens chromosome 14 open reading frame 138 (C14orf138), transcript variant 1, mRNA [NM_024558] |
| 134 | A_23_P129935 | TMEM49 | CACAGGGAGAAAAACTGGTTGTCCTGGATGTTTGAAAAGTTGGTCG TTGTCATGGTGTGTT | SEQ ID NO: 2486 | Homo sapiens transmembrane protein 49 (TMEM49), mRNA [NM_030938] |
| 135 | A_23_P132910 | FLJ20273 | CACGGGATTTTTTGTTGATGGCTGAATTCTTGTGGATTGATAAGAG GATCATGCCCTTAGC | SEQ ID NO: 2487 | Homo sapiens RNA-binding protein (FLJ20273), mRNA [NM_019027] |
| 136 | A_23_P133470 | PJA2 | GTTTGTTTCCTTTTAAGTACTGTTGATCAGTTGTGACAGTTAGTG GTTAAACTTACGTTG | SEQ ID NO: 2488 | Homo sapiens praja 2, RING-H2 motif containing (PJA2), mRNA [NM_014819] |
| 137 | A_23_P133848 | FAM8A1 | ACTTCGCCGAATTACAAAATGAGTGTGTTTTAGAATTGAAGTGACG GTAAAGGATTTGTT | SEQ ID NO: 2489 | Homo sapiens family with sequence similarity 8, member A1 (FAM8A1), mRNA [NM_016255] |
| 138 | A_23_P133691 | RRAGD | CTGCTCTGTGTATATGATGGTTATTGACATCTCTTGTATTTA TGGTGTCAAAGAAGA | SEQ ID NO: 2490 | Homo sapiens Ras-related GTP binding D (RRAGD), mRNA [NM_021244] |
| 139 | A_23_P134786 | PHF20L1 | AGTTGTATGTCCCGCAGTGCTACATACGCAGGTATGCGTAAGTG TGTATGCTTGTTTTA | SEQ ID NO: 2491 | Homo sapiens PHD finger protein 20-like 1 (PHF20L1), transcript variant 1, mRNA [NM_016018] |
| 140 | A_23_P134910 | GGH | GCAAGGTCAATTGCACAGCAGAATGTTCCAGAATTTTCCTACTGAG TTGTTGCTCTCATTA | SEQ ID NO: 2492 | Homo sapiens gamma-glutamyl hydrolase (conjugase, folylpolygammaglutamyl hydrolase) (GGH), mRNA [NM_003878] |
| 141 | A_23_P135494 | CLIC4 | GTCCTCAAGCGTAATGTTGAACAGAATGGAGGTATTTCTTTAT AATTCTTGAACAGG | SEQ ID NO: 2493 | Homo sapiens chloride intracellular channel 4 (CLIC4), mRNA [NM_013943] |
| 142 | A_23_P135499 | CLIC4 | CTTCCCTTTTTTGATGTAGAATGCAGATATTCTATACAGTTGTGTT GTCTTTTTACTAGGAC | SEQ ID NO: 2494 | Homo sapiens chloride intracellular channel 4 (CLIC4), mRNA [NM_013943] |
| 143 | A_23_P136964 | RPGR | GACGAGAACCCACACTGAGTCAGAATCATCAGAAATATCCACGAACA AATACAGAGAGAA | SEQ ID NO: 2495 | Homo sapiens retinitis pigmentosa GTPase regulator (RPGR), transcript variant A, mRNA [NM_000328] |
| 144 | A_23_P137201 | TMBIM4 | TGCACATCCGGAATGGCCTTTCTGAGAAGAAAGTCTACAGCATTCTT CTCTGCAGGTCTCT | SEQ ID NO: 2496 | Homo sapiens transmembrane BAX inhibitor motif containing 4 (TMBIM4), mRNA [NM_016056] |
| 145 | A_23_P137016 | SAT1 | GAAATAATAGAATGAGAGACGCATTCGAAAGCTTTATTACCAGTGG CGTTGTTGCATGTT | SEQ ID NO: 2497 | Homo sapiens spermidine/spermine N1-acetyltransferase 1 (SAT1), mRNA [NM_002970] |
| 146 | A_23_P138262 | PADI4 | AAGAACATTCTCTCAACAAGAGACATTGAGAGAACATAATTCATTT GTGGAGAGATGATC | SEQ ID NO: 2498 | Homo sapiens peptidyl arginine deiminase, type IV (PADI4), mRNA [NM_012387] |
| 147 | A_23_P133308 | CD58 | AAGCTGTATCCCAAGCAGCAGCGGTCATTCAAGCAGATATGCACT TATACGCATACCAT | SEQ ID NO: 2499 | Homo sapiens CD58 molecule (CD58), mRNA [NM_001779] |
| 148 | A_23_P140089 | FBXL3 | TAAGCCCAGTGGAATAGATTAATTCTTAAGCGGCTCTTTTCAGT AGTGTGACTTTTAGA | SEQ ID NO: 2500 | Homo sapiens F-box and leucine-rich repeat protein 3 (FBXL3), mRNA [NM_012158] |
| 149 | A_23_P14105 | RCBTB2 | TGACTTTCATGTCACTCACTATAAAATAGGTCTCTTAACCTGGCA CCAGTATAACTATAA | SEQ ID NO: 2501 | Homo sapiens regulator of chromosome condensation (RCC1) and BTB (POZ) domain containing protein 2 (RCBTB2), mRNA [NM_001268] |
| 150 | A_23_P143958 | RPL22L1 | ATTGGCTTGGATGGTTGCATCTGACAAGGAGAGACCTACGAACCTC GTTACTTCCAGATTA | SEQ ID NO: 2502 | Homo sapiens ribosomal protein L22-like 1, mRNA (cDNA clone IMAGE:4865966), [BC049823] |
| 151 | A_23_P144145 | DCUN1D1 | TCTTTAAGTAAATTGAATATCATCTGGGATATGTCTGTAAGTTCAATTGAATGT TTCTTACAGTCCGTa | SEQ ID NO: 2503 | Homo sapiens RP2 protein mRNA, complete cds. [AF292100] |

Fig. 7-9

| No. | Probe ID No. | Symbols of genes | Sequence | SEQ ID NO: | Descriptions of genes (letters and numbers within [ ] indicates GenBank accession No.) |
|---|---|---|---|---|---|
| 152 | A_23_P144384 | GALNT7 | TACTGTAGGGTGCTTTGGAAATAATTCCCATATCCTTGCTTGTAAGTTGGTAATATCAC | SEQ ID NO: 2504 | Homo sapiens UDP-N-acetyl-alpha-D-galactosamine:polypeptide N-acetylgalactosaminyltransferase 7 (GalNAc-T7) (GALNT7), mRNA [NM_017423] |
| 153 | A_23_P144684 | ANKRD32 | AAACTTCTACAAAACGTCTAGTATGGGCTTCGTGACTTTTTTCCAGGGTGTAGAATTTGACTC | SEQ ID NO: 2505 | Homo sapiens ankyrin repeat domain 32 (ANKRD32), mRNA [NM_032290] |
| 154 | A_23_P14564 | GPR65 | AAGAAGTTTAAATTGTGTTGCTGATCAAATTCGTGTACGTGTTTGTAACCGAAACAGGAAG | SEQ ID NO: 2506 | Homo sapiens G protein-coupled receptor 65 (GPR65), mRNA [NM_003608] |
| 155 | A_23_P14708 | SUHW4 | TCTTTGTACCTCCATACAAGTGTTAGCCTGCCAGGCTGTAAGCTTACCTTAATTAAACTT | SEQ ID NO: 2507 | Homo sapiens suppressor of hairy wing homolog 4 (Drosophila) (SUHW4), transcript variant 1, mRNA [NM_017661] |
| 156 | A_23_P14734 | RPS27L | TACAAGATCACCACGGTTTCAGGCATGCTCGAGACAGTGGTTCTTTGTGTAGGTTGTTCA | SEQ ID NO: 2508 | Homo sapiens ribosomal protein S27-like (RPS27L), mRNA [NM_015920] |
| 157 | A_23_P148584 | DOCK11 | TTGCACCACTCATGTGTTTGGTTGTACTTTTTTTAGGTAAATCTATATGCTGAAAAGTAGAGC | SEQ ID NO: 2509 | Homo sapiens dedicator of cytokinesis 11 (DOCK11), mRNA [NM_144688] |
| 158 | A_23_P149775 | ARHGAP12 | TGTATATAAAACACAGGGTTTGGAAGGTTTGTTACAGGGAGGATGGCTGTGTTGAAGAT | SEQ ID NO: 2510 | Homo sapiens Rho GTPase activating protein 12 (ARHGAP12), mRNA [NM_018287] |
| 159 | A_23_P149892 | GALNACT-2 | CATGGTGGTTCAGAATAGATGAGGCATAGGATGGTTGTTGTTTTGTTTGTTTTTGCTTTCAATTTTC | SEQ ID NO: 2511 | Homo sapiens chondroitin sulfate GalNAcT-2 (GALNACT-2), mRNA [NM_018590] |
| 160 | A_23_P150128 | SAPS3 | TTACCTTGTTAACAAGCATCACGCAATGAACATTTCAGAGCAATCTGCATATTTAACGAC | SEQ ID NO: 2512 | Homo sapiens SAPS domain family, member 3 (SAPS3), mRNA [NM_018312] |
| 161 | A_23_P151018 | LEMD3 | CCCCATCCTGTAACCTGTTGCAAGAGTGAATGTAAAAAATAGTTGTGGCATTTTAAAAGG | SEQ ID NO: 2513 | Homo sapiens LEM domain containing 3 (LEMD3), mRNA [NM_014319] |
| 162 | A_23_P151637 | RNASE2 | GTGGTAACCCAAATATGACCTGTCCTAGTAACAAAACTCGGCAAAAATTGTCACCACAGTG | SEQ ID NO: 2514 | Homo sapiens ribonuclease, RNase A family, 2 (liver, eosinophil-derived neurotoxin) (RNASE2), mRNA [NM_002934] |
| 163 | A_23_P152092 | BCL2A1 | GTAACCATATTTGCATTTGAAGGTATTCTCATCAAGAGAACTTCTACGACAGCAAATTGC | SEQ ID NO: 2515 | Homo sapiens BCL2-related protein A1 (BCL2A1), mRNA [NM_004049] |
| 164 | A_23_P154235 | NMI | CCATGTTCGTGAATCTCTTGTTTGTTCAAATGGTGCTGGCATGTTTCAACTACAATAAGTG | SEQ ID NO: 2516 | Homo sapiens N-myc (and STAT) interactor (NMI), mRNA [NM_004688] |
| 165 | A_23_P154330 | TXNDC9 | CTCAGTTCTTAAATTATCTGGGAAGGGTGTGGATTCTGTATTTCAGAATTGACTTTATC | SEQ ID NO: 2517 | Homo sapiens thioredoxin domain containing 9 (TXNDC9), mRNA [NM_005783] |
| 166 | A_23_P154367 | STK17B | TACCGAATCCCCATGAACTTGTTTCAGATTTGCTCTGTTAGCACTTTTTCTTTGACTCA | SEQ ID NO: 2518 | Homo sapiens serine/threonine kinase 17b (STK17B), mRNA [NM_004226] |
| 167 | A_23_P155765 | HMGB2 | TAAAAATGCAGGGTTGTAGGTTTTGATGGGCTACTACAGAGTTAGTTATTTGCTTTAA | SEQ ID NO: 2519 | Homo sapiens high-mobility group box 2 (HMGB2), mRNA [NM_002129] |
| 168 | A_23_P155815 | NCAPG | AAGTTAGGAAGAGACGAATGGGAGGTGGAATCCTTAAGATATGTCGAGTTATTTGCTTTAA | SEQ ID NO: 2520 | Homo sapiens non-SMC condensin I complex, subunit G (NCAPG), mRNA [NM_022346] |
| 169 | A_23_P156609 | A_23_P156609 | TTCACGTGTTTAGTAGCTGCGGGTTTCAAGTTAAATGGTCTTATTACGGCTTGGCTTCAT | SEQ ID NO: 2521 | |
| 170 | A_23_P156842 | EEF1E1 | AAGAAAAAGGAATCGTTCAGCAGTGGTTAGAATACAGAGGTCACTCAAGTAGAATCGGCACT | SEQ ID NO: 2522 | Homo sapiens eukaryotic translation elongation factor 1 epsilon 1 (EEF1E1), mRNA [NM_004280] |

Fig. 7-10

| No. | Probe ID No. | Symbols of genes | Sequence | SEQ ID NO: | Descriptions of genes (letters and numbers within [ ] indicates GenBank accession No.) |
|---|---|---|---|---|---|
| 171 | A_23_P157449 | POLR2K | GGTCTCTGTGTTGGCTCAAAATATCCTTCTTGATACAGTACTCACCATTTTAGATGTGGTTGAC | SEQ ID NO: 2523 | Homo sapiens polymerase (RNA) II (DNA directed) polypeptide K, 7.0kDa (POLR2K), mRNA [NM_005034] |
| 172 | A_23_P157452 | POLR2K | GGAATGTCTTCACTTATACTTGGATTTTGCTCTGTCTTCCCATTTCTGATTGTTGTATAGCTT | SEQ ID NO: 2524 | Homo sapiens polymerase (RNA) II (DNA directed) polypeptide K, 7.0kDa (POLR2K), mRNA [NM_005034] |
| 173 | A_23_P159650 | COX7B | CAAATACGGTAATGCTGTATTAGCTAGTGGAGCCACTTTCTGTATTGTTACATGGACATA | SEQ ID NO: 2525 | Homo sapiens cytochrome c oxidase subunit VIIb (COX7B), nuclear gene encoding mitochondrial protein, mRNA [NM_001866] |
| 174 | A_23_P159839 | C1GALT1C1 | TGCAAATCAGATGCATGTGATGATGTATGGGGTATACCGCGCTTAGGGCATTTGGGCATAT | SEQ ID NO: 2526 | Homo sapiens C1GALT1-specific chaperone 1 (C1GALT1C1), transcript variant 1, mRNA [NM_152692] |
| 175 | A_23_P160406 | KCTD3 | TTGTAGGACTGCAGTTCTGAATTTTGGGTTAAAGGTTTTGGCTGCTGTAAGAATGTGAAT | SEQ ID NO: 2527 | Homo sapiens potassium channel tetramerisation domain containing 3 (KCTD3), mRNA [NM_016121] |
| 176 | A_23_P160466 | SLC19A2 | CTTGGTATGTGGCCATATTTATAGAATGCTGAACTGAATGTCAAGTTACTGTATGCA | SEQ ID NO: 2528 | Homo sapiens solute carrier family 19 (thiamine transporter), member 2 (SLC19A2), mRNA [NM_006996] |
| 177 | A_23_P162300 | IRAK3 | TTGTCTCATGACCAAATGCACGCGCTCAATTAGAGCCATTCAAAATTCCTTAAGACATGGG | SEQ ID NO: 2529 | Homo sapiens interleukin-1 receptor-associated kinase 3 (IRAK3), mRNA [NM_007199] |
| 178 | A_23_P162586 | ACTR6 | TTAACGGCTTCACTGGACAGTTTTCCTTAGAAGGTAGTTTTGTGTGACTGTGACTAAACT | SEQ ID NO: 2530 | Homo sapiens ARP6 actin-related protein 6 homolog (yeast) (ACTR6), mRNA [NM_022496] |
| 179 | A_23_P163216 | ATP8B4 | ATCAGTGTATTTTCCATAAAGTGATTCGGGCATATTTGTGTCGAAAACCTCAGTTGTGTCA | SEQ ID NO: 2531 | Homo sapiens ATPase, Class I, type 8B, member 4 (ATP8B4), mRNA [NM_024837] |
| 180 | A_23_P165624 | TNFAIP6 | AAATGGTACGAAGATAACCAAAATCTGGTACTGGACAATATCAAGTATGGTGATCA | SEQ ID NO: 2532 | Homo sapiens tumor necrosis factor, alpha-induced protein 6 (TNFAIP6), mRNA [NM_007115] |
| 181 | A_23_P167005 | GPR160 | AGGCACAGAAATGCTTATTCTGGTCACTGTCCTTTGTATGTGAGCATTCAAGTTAGTGGC | SEQ ID NO: 2533 | Homo sapiens G protein-coupled receptor 160 (GPR160), mRNA [NM_014373] |
| 182 | A_23_P167983 | HIST1H2AC | GCATTATGCAAATGCATTATATTTATGTAACCTGTCACTGTTGGTAGGCACTTGAGTT | SEQ ID NO: 2534 | Histone H2A type 1-C [Source:Uniprot/SWISSPROT;Acc:Q93077] [ENST00000314083] |
| 183 | A_23_P16817 | CLK1 | ATGGAAAGGATTCTTGGACCTCTACCAAAACATATGTACACAGAAAACCAGGAAAGGTAAA | SEQ ID NO: 2535 | Homo sapiens CDC-like kinase 1 (CLK1), transcript variant 1, mRNA [NM_004071] |
| 184 | A_23_P168656 | GTPBP10 | AATTTGTGGATTTCTGATACAATGTCTCTACTGAGCCAGCATCAAAGCATGCTGTTAGT | SEQ ID NO: 2536 | Homo sapiens GTP-binding protein 10 (putative) (GTPBP10), transcript variant 2, mRNA [NM_033107] |
| 185 | A_23_P168882 | TP53INP1 | GGGAGGTTAGATGTGTGTTTCAGGCTTGGAGTGTATGAGTGGTTTGCTTGTATTTTCCT | SEQ ID NO: 2537 | Homo sapiens tumor protein p53 inducible nuclear protein 1 (TP53INP1), mRNA [NM_033285] |
| 186 | A_23_P168974 | SDCBP | GGAAACGAACAAGTTCATCTTGAGAATTTATACAGACTGGTCGAGAAGAAGCATCCTCAG | SEQ ID NO: 2538 | Homo sapiens cDNA FLJ46804 fis, clone TRACH3032570, highly similar to Homo sapiens syndecan binding protein (syntenin) (SDCBP), mRNA [AK128645] |
| 187 | A_23_P16915 | QPCT | CATATTCATTTTAAGAAGAGGGTGTTCAGTTCGCATCTGATACCGTCTCCTTTCCCT | SEQ ID NO: 2539 | Homo sapiens glutaminyl-peptide cyclotransferase (glutaminyl cyclase) (QPCT), mRNA [NM_012413] |
| 188 | A_23_P169278 | AGTPBP1 | AAACCTGAGTATCATTGGATCGAATTTTATCTCCCTATAGTTATATCCTGGACTCAAGTGG | SEQ ID NO: 2540 | Homo sapiens ATP/GTP binding protein 1 (AGTPBP1), mRNA [NM_015239] |

Fig. 7-11

| No. | Probe ID No. | Symbols of genes | Sequence | SEQ ID NO: | Descriptions of genes (letters and numbers within [ ] indicates GenBank accession No.) |
|---|---|---|---|---|---|
| 189 | A_23_P169576 | EXOC6 | ATGCTGAATCTCCGCTTTGGCTTTTCAGGATTTAGGCCTGTAAGAAACTATGCCTGATTC | SEQ ID NO: 2541 | Homo sapiens exocyst complex component 6 (EXOC6), transcript variant 2, mRNA [NM_001013848] |
| 190 | A_23_P17021 | SCRN3 | GTCAAAGTTAGTTCTTAGTGATCATATGGTCAGGTAATATTAGTTCTTAGTGATCAGTGG | SEQ ID NO: 2542 | Homo sapiens secernin 3 (SCRN3), mRNA [NM_024583] |
| 191 | A_23_P170233 | CSTA | AACTGGCTACTGAGTCATGATCCTTGCTGATAATATAACCATCAATAAAGAAGCATTCT | SEQ ID NO: 2543 | Homo sapiens cystatin A (stefin A) (CSTA), mRNA [NM_005213] |
| 192 | A_23_P18325 | PDCD10 | CCAAGCGACTAATTCATCAAACGAACTTAATACTTCAGACCTTCAAAACGTGGCCTGAA | SEQ ID NO: 2544 | Homo sapiens programmed cell death 10 (PDCD10), transcript variant 1, mRNA [NM_007217] |
| 193 | A_23_P18372 | B3GNT5 | AAAATGTCAACAAAGGGAAAATAAACTATCAGGTTGGATGGTCACTTGAATAGAGATGGT | SEQ ID NO: 2545 | Homo sapiens UDP-GlcNAc:betaGal beta-1,3-N-acetylglucosaminyltransferase 5 (B3GNT5), mRNA [NM_032047] |
| 194 | A_23_P19543 | SRPK1 | CTGTCAAATTGGCACGATCTCACTCAGCTAAAGGATTCTATTTGCTGTCAGTAAAATAAAGC | SEQ ID NO: 2546 | Homo sapiens SFRS protein kinase 1 (SRPK1), mRNA [NM_003137] |
| 195 | A_23_P200030 | FPGT | TAAAAATTGGTAAACTAGAAGTAACTGTCCACAACCCTCAGTTATGATACTTATGTGCG | SEQ ID NO: 2547 | Homo sapiens fucose-1-phosphate guanylyltransferase (FPGT), mRNA [NM_003838] |
| 196 | A_23_P200493 | LBR | GAGCGCTTTATCAATACAGTGCTGCAATTTCTGGATATCAGGTACACTTGTTTTAAGT | SEQ ID NO: 2548 | Homo sapiens lamin B receptor (LBR), transcript variant 1, mRNA [NM_002296] |
| 197 | A_23_P200507 | CNIH4 | TGGTTGAAGTCAGCGTACTACGAGTGAGGAGCAGACAGTTGTTCTTAAATCAT | SEQ ID NO: 2549 | Homo sapiens cornichon homolog 4 (Drosophila) (CNIH4), mRNA [NM_014184] |
| 198 | A_23_P201619 | NEK7 | TGAAGGCCAAGAGGAAGTCACTGTTAAAGGACTCTGTGCCATCTTACAACCTTGGATGAA | SEQ ID NO: 2550 | Serine/threonine-protein kinase Nek7 (EC 2.7.11.1) (NimA-related protein kinase 7). [Source:Uniprot/SWISSPROT;Acc:Q8TDX7] [ENST00000367385] |
| 199 | A_23_P201758 | CD46 | CTCATGAAGTGCAACTGTGGCTTAGCTAATATGCAATGTGGCTTGAATGTAGGTAGGATC | SEQ ID NO: 2551 | Homo sapiens CD46 molecule, complement regulatory protein (CD46), transcript variant a, mRNA [NM_002389] |
| 200 | A_23_P201951 | ARID4B | ATGTTACAGGGTTTGAATTAGGCTAAAAGGTCTAAAAAGGTCTTGCAGATGGCTTTCATGGCCCTTCAAA | SEQ ID NO: 2552 | Homo sapiens AT rich interactive domain 4B (RBP1-like) (ARID4B), transcript variant 1, mRNA [NM_016374] |
| 201 | A_23_P20225 | RRM2B | TGGTTCCTTGTTAAAAAAGTTAAAGAATTTGAAAAGAAGAATCTCATATTCCGGAGCATTAGGA | SEQ ID NO: 2553 | Homo sapiens ribonucleotide reductase M2 B (TP53 inducible) (RRM2B), mRNA [NM_015713] |
| 202 | A_23_P202637 | SAPS3 | TGATTATTCCTACAAGTGAAACAGTAGACTATTTGGAGTGTATATGGCTGTGTTTTGGG | SEQ ID NO: 2554 | Homo sapiens SAPS domain family, member 3 (SAPS3), mRNA [NM_018312] |
| 203 | A_23_P202978 | CASP1 | CTGTTCCTGTGATGTGGAGGGAAATTTTCCGGCAAGGTCGGATTTTCATTTGAGCAGCCAGA | SEQ ID NO: 2555 | Homo sapiens caspase 1, apoptosis-related cysteine peptidase (interleukin 1, beta, convertase) (CASP1), transcript variant alpha, mRNA [NM_033292] |
| 204 | A_23_P203376 | MS4A6A | ACGGGGCTGTAAATTACCATTTACTAGAATTAGCCAAATAGTCTGAATTTCAGAAAACAA | SEQ ID NO: 2556 | Homo sapiens membrane-spanning 4-domains, subfamily A, member 6A (MS4A6A), transcript variant 1, mRNA [NM_152852] |
| 205 | A_23_P203498 | TRIM22 | GTAGATAAGAATCTATCACTAAGTAATGTATCGTTCAGAATGTGTTGGTTTACCAGTGAC | SEQ ID NO: 2557 | Homo sapiens tripartite motif-containing 22 (TRIM22), mRNA [NM_006074] |

Fig. 7-12

| No. | Probe ID No. | Symbols of genes | Sequence | SEQ ID NO: | Descriptions of genes (letters and numbers within [ ] indicates GenBank accession No.) |
|---|---|---|---|---|---|
| 206 | A_23_P204269 | USP15 | GACCAAGGAATAAATGAGGTATGTTGATCATGGCTTTGCTTTAATATCTTGATATTAAAGCTG | SEQ ID NO: 2558 | Homo sapiens ubiquitin specific peptidase 15 (USP15), mRNA [NM_006313] |
| 207 | A_23_P204564 | PPP1R12A | GTATAAGATGTTAGATTCTGTAATCTTCACATTCATTTTAGCAGGTACTGAGTGATGCTG | SEQ ID NO: 2559 | Homo sapiens protein phosphatase 1, regulatory (inhibitor) subunit 12A (PPP1R12A), mRNA [NM_002480] |
| 208 | A_23_P205027 | ABHD13 | ATTTGTGCAGAATGATAAAGAATGTTCGTTTTAGAAGTGTGTTATGTCTGTACCTGCTG | SEQ ID NO: 2560 | Homo sapiens abhydrolase domain containing 13 (ABHD13), mRNA [NM_032859] |
| 209 | A_23_P205336 | C14orf129 | CAATTCATTGCCAGACTTCATTGGAATGCTTGTTTGATGATGTATGTTCATTCTCAGCT | SEQ ID NO: 2561 | Homo sapiens chromosome 14 open reading frame 129 (C14orf129), mRNA [NM_016472] |
| 210 | A_23_P20606 | NIPSNAP3A | GTAAGTACCACTCAAAAAATAGTTCTGTTACTTCTGCATGGTATTTCAGTGTGTGTC | SEQ ID NO: 2562 | Homo sapiens nipsnap homolog 3A (C. elegans) (NIPSNAP3A), mRNA [NM_015469] |
| 211 | A_23_P206396 | CKLF | ATTATGAACTGCAGTGGTAAGAACAGTATTCATGGTCATCGTATCTGTGTTGGCAGTGATA | SEQ ID NO: 2563 | Homo sapiens chemokine-like factor (CKLF), transcript variant 1, mRNA [NM_016951] |
| 212 | A_23_P207299 | LOC51136 | GCAAAACAGCAATTTGAAATTAGAACGTAGTGGTTTTAGAGAACTCAGGTATTCTTTCCTG | SEQ ID NO: 2564 | Homo sapiens PTD016 protein (LOC51136), mRNA [NM_016125] |
| 213 | A_23_P207666 | USP6 | TCCATTACCCTTTCTCCTCATAGGTAGTAGTAATTACCAATCGTAACTAAGCAATTGTGTGT | SEQ ID NO: 2565 | Homo sapiens ubiquitin specific peptidase 6 (Tre-2 oncogene) (USP6), mRNA [NM_004505] |
| 214 | A_23_P207999 | PMAIP1 | TTAGAGAATCGTTCGTAGTGTTTTGCCGAAGATTACCGCTCTGGCCTAGTGTGAAGGGAGAT | SEQ ID NO: 2566 | Homo sapiens phorbol-12-myristate-13-acetate-induced protein 1 (PMAIP1), mRNA [NM_021127] |
| 215 | A_23_P208119 | PSTPIP2 | AATTAGGTTTTCAACATGGGAACATGAAATCCACTTCTGGATTTGGAGCATCCACTCGA | SEQ ID NO: 2567 | Homo sapiens proline-serine-threonine phosphatase interacting protein 2 (PSTPIP2), mRNA [NM_024430] |
| 216 | A_23_P209116 | CYP4F3 | GTTGAAATTTGGGTGGAATAAATTCTGGATTTCTATTCCATGTTGGACCAATACC | SEQ ID NO: 2568 | Homo sapiens mRNA for leukotriene B4 omega-hydroxylase, complete cds. [AB002454] |
| 217 | A_23_P209625 | CYP1B1 | CTGTGTTTATATGGAAGAAAGTAAGGTGCTTGGAGTTTACCTGGCTTATTAATATGCTT | SEQ ID NO: 2569 | Homo sapiens cytochrome P450, family 1, subfamily B, polypeptide 1 (CYP1B1), mRNA [NM_000104] |
| 218 | A_23_P210274 | PRE3 | GGATCAGTATGCCGTAGGATTACAGAAGATATTTCACATGCTTATTTCATCATCGGCAC | SEQ ID NO: 2570 | Homo sapiens preimplantation protein 3 (PRE3), transcript variant 1, mRNA [NM_015337] |
| 219 | A_23_P211047 | BACH1 | ATGTTAGATGCAGTAGACGATAGACAGGTTGCATGTGGACACTCAGTCACATTAAGCACTTG | SEQ ID NO: 2571 | Homo sapiens BTB and CNC homology 1, basic leucine zipper transcription factor 1 (BACH1), transcript variant 1, mRNA [NM_206866] |
| 220 | A_23_P211840 | UBE1C | GCCACCCTAGAGGGAAAAAATAGAAACACTTTACTTACGAGTCGGTAACGCTCATTGAAGAA | SEQ ID NO: 2572 | Homo sapiens ubiquitin-activating enzyme E1C (UBA3 homolog, yeast) (UBE1C), transcript variant 1, mRNA [NM_003968] |
| 221 | A_23_P211899 | THC2522899 | AACAAAGCATTTCGTTAAAATGTTTGGTAGGTTAAGCTGTGCTGTTCTACTGATGGTTG | SEQ ID NO: 2573 | GPR27_HUMAN (Q9NS67) Probable G-protein coupled receptor 27 (Super conserved receptor expressed in brain 1), complete [THC2522889] |
| 222 | A_23_P212061 | MME | TTTATTACTGCCAGAAGAACAACTATCCTGACTCTAATATCATTCACTAGGTTTGCCTG | SEQ ID NO: 2574 | Homo sapiens membrane metallo-endopeptidase (MME), transcript variant 2b, mRNA [NM_007289] |
| 223 | A_23_P212728 | TBC1D23 | TGTACCGTGTTAACAGGCAGTCATTTTGATTTAGTTATGGAAATCAAGTGAATAAAAGGC | SEQ ID NO: 2575 | Homo sapiens TBC1 domain family, member 23, mRNA (cDNA clone MGC:8800 IMAGE:3847561), complete cds. [BC020955] |

Fig. 7-13

| No. | Probe ID No. | Symbols of genes | Sequence | SEQ ID NO: | Descriptions of genes (letters and numbers within [ ] indicate GenBank accession No.) |
|---|---|---|---|---|---|
| 224 | A_23_P213247 | FBXL5 | ATGGAGGTGATTGGTTCTTCTTTACACATTAACACTGTACCAAGCTTTGGAGATCTTTTCC | SEQ ID NO: 2576 | Homo sapiens F-box and leucine-rich repeat protein 5 (FBXL5), transcript variant 2, mRNA [NM_033535] |
| 225 | A_23_P213661 | HISPPD1 | GTATGTAAGTTTTCTGTTTGTGAAAATGTAGTTAGTTACTGACTGTGGAGGTCATAAGG | SEQ ID NO: 2577 | Homo sapiens histidine acid phosphatase domain containing 1 (HISPPD1), mRNA [NM_015216] |
| 226 | A_23_P215751 | NDUFA5 | TAAAAGTGGAGTCACTAAATAGTTTCGAGTAGTTTCTAATATAAGTGTAGGTGGGTATC | SEQ ID NO: 2578 | Homo sapiens NADH dehydrogenase (ubiquinone) 1 alpha subcomplex, 5, 13kDa (NDUFA5), nuclear gene encoding mitochondrial protein, mRNA [NM_005000] |
| 227 | A_23_P216325 | ASAH1 | ATGAAGTCGATGCTAAGCAAGGGTAGATGGTATGTGGTACAAAGAAATTATGACGGTTGGA | SEQ ID NO: 2579 | Homo sapiens N-acylsphingosine amidohydrolase (acid ceramidase) 1 (ASAH1), transcript variant 2, mRNA [NM_004315] |
| 228 | A_23_P217384 | AP1S2 | AAACGTGTTGCTCTCTTCAGAGTATTATGTGTAAAGTCATTGTTTAAAGCACGAATGTTC | SEQ ID NO: 2580 | Homo sapiens adaptor-related protein complex 1, sigma 2 subunit (AP1S2), mRNA [NM_003916] |
| 229 | A_23_P217564 | ACSL4 | GTTATAGGTGCTTAGAAACACATAATTAACACTTAAGGTTGGGTGCTGCTAATTCTTTG | SEQ ID NO: 2581 | Homo sapiens acyl-CoA synthetase long-chain family member 4 (ACSL4), transcript variant 1, mRNA [NM_004458] |
| 230 | A_23_P217737 | ENST00000341514 | CACAAGCATGAGTTCGTTGTTCTTCAGTTAAAAGAGTTGTTCACAGTGTTGATAAGCAA | SEQ ID NO: 2582 | Copper-transporting ATPase 1 (EC 3.6.3.4) (Copper pump 1) (Menkes disease-associated protein). [Source:Uniprot/SWISSPROT:Acc:Q04656] [ENST00000341514] |
| 231 | A_23_P218928 | C4orf18 | CAGATGAGTTCATTTGCTTCTGTAGATGTGTTTCAGAGGCTAGGTACAAGAGGAATGTTTG | SEQ ID NO: 2583 | Homo sapiens chromosome 4 open reading frame 18 (C4orf18), transcript variant 2, mRNA [NM_016613] |
| 232 | A_23_P219072 | SAMD9 | AAGCTACCTCCAGATTAGTAAAGCCAGTTGAAAAACTAAAAGATCAGGTTCGAGAAGTCT | SEQ ID NO: 2584 | Homo sapiens sterile alpha motif domain containing 9 (SAMD9), mRNA [NM_017654] |
| 233 | A_23_P22433 | RP2 | TTATTTCTCTTGCATTAATAGTACTGCTGTTTTTGTTTTGCTTCTTTATATTTATGTCTA | SEQ ID NO: 2585 | Homo sapiens retinitis pigmentosa 2 (X-linked recessive) (RP2), mRNA [NM_006915] |
| 234 | A_23_P23048 | S100A9 | GAGCTGGTGCGAAAAGATCTGGAAAATTTCTGAAGAAGGAGAATAAGAATGAAAAGGTC | SEQ ID NO: 2586 | Homo sapiens S100 calcium binding protein A9 (S100A9), mRNA [NM_002965] |
| 235 | A_23_P23705 | SPATA6 | CATCTTTGCTAAGTGTCTCATTATCTTCATCCCCTAGGAGGAAAAGAGTGGTCCATGTTG | SEQ ID NO: 2587 | Spermatogenesis-associated protein 6 precursor. [Source:Uniprot/SWISSPROT:Acc:Q8NHH7] [ENST00000371847] |
| 236 | A_23_P23960 | BLOC1S2 | GAGTAAACTGGAGAGTGTGGGTATTCCTGAACCTTCTTGAGACAGAATCCCTCAGAAT | SEQ ID NO: 2588 | Homo sapiens biogenesis of lysosome-related organelles complex-1, subunit 2 (BLOC1S2), transcript variant 2, mRNA [NM_001001342] |
| 237 | A_23_P24004 | IFIT2 | AGCTGACCGAGCATCAGCCACACTCTGGGTTGGAAAATGTTTGCCTGTTGGAATTAATTT | SEQ ID NO: 2589 | Homo sapiens interferon-induced protein with tetratricopeptide repeats 2 (IFIT2), mRNA [NM_015471] |
| 238 | A_23_P24260 | ENST00000371207 | AAGGCACAATCTATTTTTCCAAGGTTTAATTTAGTGAGAGGGGCAGCATTAGTGTGGAGTG | SEQ ID NO: 2590 | Ectonucleoside triphosphate diphosphohydrolase 1 (EC 3.6.1.5) (NTPDase 1) (Ecto-ATP diphosphohydrolase) (ATPDase) (Lymphoid cell activation antigen) (Ecto-apyrase) (CD39 antigen). [Source:Uniprot/SWISSPROT:Acc:P49961] [ENST00000371207] |

Fig. 7-14

| No. | Probe ID No. | Symbols of genes | Sequence | SEQ ID NO: | Descriptions of genes (letters and numbers within [ ] indicates GenBank accession No.) |
|---|---|---|---|---|---|
| 239 | A_23_P24365 | ANKRD49 | GGGCACTGCTTGTATAGTCTCTCAAGTTCAGCAGGAAATGTTGATTTTCTAAGGTCCTCAT | SEQ ID NO: 2591 | Homo sapiens ankyrin repeat domain 49 (ANKRD49), mRNA [NM_017704] |
| 240 | A_23_P250002 | HACE1 | TAAGCAGTCATTGTTGTTGCCAGTAATGTTTGAGAGACATGTAAGATTGAAAGTTTTGCTA | SEQ ID NO: 2592 | Homo sapiens HECT domain and ankyrin repeat containing, E3 ubiquitin protein ligase 1 (HACE1), mRNA [NM_020771] |
| 241 | A_23_P250800 | ST3GAL6 | ATGTCACGAAGTTCAGCTAGCTGCTTGGTTTTAAATACAACTTTCTGACCTCAAGAGTCCTTT | SEQ ID NO: 2593 | Homo sapiens ST3 beta-galactoside alpha-2,3-sialyltransferase 6 (ST3GAL6), mRNA [NM_006100] |
| 242 | A_23_P251002 | NBN | CCTGATGGATCTGACAAGATGGACGTGAGAGGATGAAAATCTGTCTGATTAGTTTTGACTG | SEQ ID NO: 2594 | |
| 243 | A_23_P251480 | NBN | TTGGAAGAAACGTGAACTCAAGGAAGAAGTCACTATGGTCAGCTAAAGAAATATGTAAGA | SEQ ID NO: 2595 | Homo sapiens nibrin (NBN), transcript variant 1, mRNA [NM_002485] |
| 244 | A_23_P251825 | IFRD1 | CTATGAGACACCTTTAAGGAGGTTCTTGGATCGAGGGATGCAGTACCCAGTTGCAGTCAAAT | SEQ ID NO: 2596 | Homo sapiens interferon-related developmental regulator 1 (IFRD1), transcript variant 2, mRNA [NM_001007245] |
| 245 | A_23_P251937 | CPEB4 | GTATGTCAGTTAATTGTACTACTTGGCTGAATTCCATATAGTTTTACTGTGTATGGGG | SEQ ID NO: 2597 | Homo sapiens cytoplasmic polyadenylation element binding protein 4 (CPEB4), mRNA [NM_030627] |
| 246 | A_23_P252145 | C1GALT1 | ATATGTCTATATATAGAGGAAGTGTGTTTTTTAAATGGTGGCCAGGTAGAGGAACTAG | SEQ ID NO: 2598 | Homo sapiens core 1 synthase, glycoprotein-N-acetylgalactosamine 3-beta-galactosyltransferase, 1 (C1GALT1), mRNA [NM_020156] |
| 247 | A_23_P252201 | EAF2 | CAGGATTCCTGATATAGATGGCAGTCATAATAGATTCGAGACAACAGTGGGCCTTGCTGAT | SEQ ID NO: 2599 | Homo sapiens ELL associated factor 2 (EAF2), mRNA [NM_018456] |
| 248 | A_23_P25235 | CLEC4D | CATTTAACCACGCAGAGTATTCTGGCATAAGAATGAACCCGACAAGTCTCAGGGAGAAA | SEQ ID NO: 2600 | Homo sapiens C-type lectin domain family 4, member D (CLEC4D), mRNA [NM_080387] |
| 249 | A_23_P252371 | RBBP8 | GGCAAGGAGCAGAAGACATAGGACGTTGAAACAGAAACAAGAAGGATGAAAGGACAGTTTTTT | SEQ ID NO: 2601 | Homo sapiens retinoblastoma binding protein 8 (RBBP8), transcript variant 1, mRNA [NM_002894] |
| 250 | A_23_P253012 | GRAMD1C | GAATTCCAACGAACCACTACCGTAGGGGTAACAGTGAACCTACCTGGGTTTGTTTTGTTTTG | SEQ ID NO: 2602 | Homo sapiens GRAM domain containing 1C (GRAMD1C), mRNA [NM_017577] |
| 251 | A_23_P253602 | BMX | TTATGCTGCTCCTGATATAACACTTTCCAGCCTATAGCAAGAAGCACATTTTCAGACTGCA | SEQ ID NO: 2603 | Homo sapiens BMX non-receptor tyrosine kinase (BMX), mRNA [NM_001721] |
| 252 | A_23_P254472 | C6orf211 | TTCATTTCAATAGCTTGTTTCATTTGCACCGCCCTTTGTATTTTGATTGACCTGTAGAATGG | SEQ ID NO: 2604 | Homo sapiens chromosome 6 open reading frame 211 (C6orf211), mRNA [NM_024573] |
| 253 | A_23_P254702 | DEK | TTTTTATTAACTGCTTTTGCCCATATAACATGCTGATATTACTGGAAACCTAGCCAGC | SEQ ID NO: 2605 | Homo sapiens DEK oncogene (DNA binding) (DEK), mRNA [NM_003472] |
| 254 | A_23_P255503 | FNDC3A | ATACTTGCATTGAGCCTCACTGACAAAATTAGTGCAGGAGAAAAGCATTTTAATGT | SEQ ID NO: 2606 | Homo sapiens fibronectin type III domain containing 3A (FNDC3A), transcript variant 2, mRNA [NM_014923] |
| 255 | A_23_P255444 | DAPP1 | AGAAGAATGAGATAGTGATGTCCACAGTTCATTGGCAGAGAATCTAACATTTTAATGT | SEQ ID NO: 2607 | Homo sapiens dual adaptor of phosphotyrosine and 3-phosphoinositides (DAPP1), mRNA [NM_014395] |
| 256 | A_23_P256231 | FBXO30 | GCCCTTTTAAAGTTTTGCTGAAGAATGTGTCTGTGGTTAGGATAGCACAAGCATTAACTTT | SEQ ID NO: 2608 | Homo sapiens F-box protein 30 (FBXO30), mRNA [NM_032145] |
| 257 | A_23_P256342 | SNX13 | ATTAGGCAGGTGAATGATCCTTGAAACATCTCTTCAGGTCTGGAGAAAGAGACAGAATG | SEQ ID NO: 2609 | Homo sapiens sorting nexin 13 (SNX13), mRNA [NM_015132] |

Fig. 7-15

| No. | Probe ID No. | Symbols of genes | Sequence | SEQ ID NO: | Descriptions of genes (letters and numbers within [ ] indicates GenBank accession No.) |
|---|---|---|---|---|---|
| 258 | A_23_P255432 | PPP2R5A | TTGGTCAAGTATTTCTCACATCTTTTGTTATCAGAGATACCATTCCAATCTCTAACTTGG | SEQ ID NO: 2610 | Homo sapiens protein phosphatase 2, regulatory subunit B', alpha isoform (PPP2R5A), mRNA [NM_006243] |
| 259 | A_23_P25735 | PSMA6 | TAGGAGAGAGAGACTAAACATTGTCGTTAGTTTACCAGATCCGTGATGCCACTTACCTGT | SEQ ID NO: 2611 | Homo sapiens proteasome (prosome, macropain) subunit, alpha type, 6 (PSMA6), mRNA [NM_002791] |
| 260 | A_23_P255054 | SNX14 | CATCAGACTTCTGTTTGATGGCTTACAGCAACCAGTACTCAACAAGCAGCTGACTTATGT | SEQ ID NO: 2612 | Homo sapiens sorting nexin 14 (SNX14), transcript variant 1, mRNA [NM_153816] |
| 261 | A_23_P26021 | COPS2 | TGGTTTTTGATCAACTGGTTTGTGTTTTGCTGCTGACATTTATCCCAAGAAAACAGCTT | SEQ ID NO: 2613 | Homo sapiens COP9 constitutive photomorphogenic homolog subunit 2 (Arabidopsis) (COPS2), mRNA [NM_004236] |
| 262 | A_23_P2705 | P2RY5 | TCTGTATTGGTGTGTTTCCAACTGTTGTTTTGACCGTATAGTTTACTACTTACATCGGACA | SEQ ID NO: 2614 | Homo sapiens purinergic receptor P2Y, G-protein coupled, 5 (P2RY5), mRNA [NM_005767] |
| 263 | A_23_P28169 | ARL6IP6 | GGAAAGCAAATAATGCCTACTACTCGGACTTTATAGAAGCTACTTTAAATCAGAATAT | SEQ ID NO: 2615 | Homo sapiens ADP-ribosylation-like factor 6 interacting protein 6 (ARL6IP6), mRNA [NM_152522] |
| 264 | A_23_P28485 | GCA | TGGTGGTGTTTGAGGGTTGGCTAGAAATGAAAGCCATGGATTTTGTGGCATGTTTGTAATA | SEQ ID NO: 2616 | Homo sapiens grancalcin, EF-hand calcium binding protein (GCA), mRNA [NM_012198] |
| 265 | A_23_P29005 | SAMSN1 | CTCTGGTTGCTATATCTCATCAGGAGAATTCAGATAATGGGAAAGAGGATCTGGAGTGTGA | SEQ ID NO: 2617 | Homo sapiens SAM domain, SH3 domain and nuclear localization signals 1 (SAMSN1), mRNA [NM_022136] |
| 266 | A_23_P30069 | FLJ31033 | AGATTTGTTTAAGTCGCTACACTTCTTATTCTAAATGATCAAGAGTACACTTGGTGG | SEQ ID NO: 2618 | Homo sapiens cDNA FLJ13681 fis, clone PLACE2000014, weakly similar to HYPOTHETICAL HELICASE C28H8.3 IN CHROMOSOME III. [AK023743] |
| 267 | A_23_P30175 | ERBB2IP | TAGTTGAGGCTAGTCTGGAACGTTCATTAGAGCAATATTGGTTATTGCACTTCATTTT | SEQ ID NO: 2619 | Homo sapiens erbb2 interacting protein (ERBB2IP), transcript variant 2, mRNA [NM_018695] |
| 268 | A_23_P302470 | SULT1B1 | TGTCTAAGTCAGAAATCTGAAGAAATAAGAGATTGTGTGTAGTTGATTGAAACGAGGGCA | SEQ ID NO: 2620 | Homo sapiens sulfotransferase family, cytosolic, 1B, member 1 (SULT1B1), mRNA [NM_014465] |
| 269 | A_23_P302550 | RGS18 | GAGTCTAAGGCCCTAGGGATTTGGGCATCTGCCACATTGGTTCATATTCAGAAAGTGTTA | SEQ ID NO: 2621 | Homo sapiens regulator of G-protein signalling 18 (RGS18), mRNA [NM_130782] |
| 270 | A_23_P30307 | CRSP9 | CAATTGTACTGGACAGAAGAATGAAGAACTCAAAGAGAAAATTCAGGTCATAGGAGAGATACGAT | SEQ ID NO: 2622 | Homo sapiens cofactor required for Sp1 transcriptional activation, subunit 9, 33kDa (CRSP9), mRNA [NM_004270] |
| 271 | A_23_P303210 | IKIP | TTTAGGTTCCAACTGTGTTAGACATGAGTTTCCTAGATCCATGGTCTCTAGATGGTTTAC | SEQ ID NO: 2623 | Homo sapiens IKK interacting protein (IKIP), transcript variant 1, mRNA [NM_153687] |
| 272 | A_23_P303260 | STX7 | GTCTGATGTTTACGGGGGAGAGTGTAGTTACTAAAAATGTTTACATAATTCAGAAGAAG | SEQ ID NO: 2624 | Homo sapiens syntaxin 7 (STX7), mRNA [NM_003569] |
| 273 | A_23_P305060 | PBEF1 | TGCCTGTGCTCTAATATGCACCTCAAGCATTTTAAGGAGATAATGTTTTTAGAGAGAATT | SEQ ID NO: 2625 | Homo sapiens pre-B-cell colony enhancing factor 1 (PBEF1), mRNA [NM_005746] |
| 274 | A_23_P305723 | MIER1 | TGATGTATTTTCAAATAGAGTTCAGGATCTGCAATTCAGTTCAACACAAGTTTGTTGGAGC | SEQ ID NO: 2626 | Homo sapiens mesoderm induction early response 1 homolog (Xenopus laevis) (MIER1), transcript variant 1, mRNA [NM_020948] |
| 275 | A_23_P305759 | ABHD3 | AGTTGGTAGACTGGAAGTCAGTAGGAAATTCCAGTATGTGTCTAAATTCTGTGATGATGTT | SEQ ID NO: 2627 | Homo sapiens abhydrolase domain containing 3 (ABHD3), mRNA [NM_138340] |
| 276 | A_23_P307940 | CAPZA2 | CTACAAGATTGGCAAAGAGATGCAGAAGATGCATAAGAATGAACATTGCATGACCGGATCATT | SEQ ID NO: 2628 | Homo sapiens capping protein (actin filament) muscle Z-line, alpha 2 (CAPZA2), mRNA [NM_006136] |

Fig. 7-16

| No. | Probe ID No. | Symbols of genes | Sequence | SEQ ID NO: | Descriptions of genes (letters and numbers within [ ] indicates GenBank accession No.) |
|---|---|---|---|---|---|
| 277 | A_23_P308800 | GLS | CGGAAGAAGAGATAAGAATACTGCAATAGGCCCTCAAACTTAAAAAAGAAAAAACTTTGC | SEQ ID NO: 2628 | Homo sapiens glutaminase C mRNA, complete cds. [AF158555] |
| 278 | A_23_P30995 | CYB5R4 | TGGAATTGTGGACAGTGCGATTGCCATTTACAGAACAAGGAGTAAGGTTGCTGCATGATGTCAAC | SEQ ID NO: 2629 | Homo sapiens cytochrome b5 reductase 4 (CYB5R4), mRNA [NM_016230] |
| 279 | A_23_P31097 | OSTM1 | ACTGAAAATGTGCTGGGGTTTGTTCTGCTGTCACTGTTTATGCTGCTGGAAGCTTAGCACT | SEQ ID NO: 2630 | Homo sapiens osteopetrosis associated transmembrane protein 1 (OSTM1), mRNA [NM_014028] |
| 280 | A_23_P312246 | CCDC82 | GGCTTTATAACGAGATGAGTGTCAAGTGAATGAGGTGTTGATATCCTGTCAGTTTAGTCAA | SEQ ID NO: 2631 | Homo sapiens coiled-coil domain containing 82 (CCDC82), mRNA [NM_024725] |
| 281 | A_23_P312932 | KRTAP8-1 | GGCTATGGCTTCGGCTATGGCTACAACGGGCTGTGGGGCTTTGGGGTACAGGAGATACTCG | SEQ ID NO: 2632 | Homo sapiens keratin associated protein 8-1 (KRTAP8-1), mRNA [NM_175857] |
| 282 | A_23_P314191 | ZDHHC17 | TGGATAGTTTTAGGAAATAGGAAGTTAATTCTCAGGACTGAAGATGAATTACTTCGTTGG | SEQ ID NO: 2633 | Homo sapiens zinc finger, DHHC-type containing 17 (ZDHHC17), mRNA [NM_015336] |
| 283 | A_23_P314691 | NFYB | GGAGGCATTTACTAACCAGTTACCAGCTGGCTTAATAACGACAGACGGGTCAACAACAAAA | SEQ ID NO: 2634 | Homo sapiens nuclear transcription factor Y, beta (NFYB), mRNA [NM_006166] |
| 284 | A_23_P317001 | BNIP2 | TTTGAAGCCGGTAGTTTGTTTGACCTAGTTAGATTGTGGTGTTTATTCAAGTTTGAAATCA | SEQ ID NO: 2635 | Homo sapiens BCL2/adenovirus E1B 19kDa interacting protein 2 (BNIP2), mRNA [NM_004330] |
| 285 | A_23_P317347 | ESCO1 | GCTAATTTTTAAAAGGCCTGAACTAATAGTTTGAAGAAAACCCCTATAGAAAAGGAAAGCTC | SEQ ID NO: 2636 | Homo sapiens establishment of cohesion 1 homolog 1 (S. cerevisiae) (ESCO1), mRNA [NM_052911] |
| 286 | A_23_P317465 | RAB8B | CCTTGAATATAGAGGGACCTAGACAGGATATGCTAAAATAATTTCAAATGTTAGCAC | SEQ ID NO: 2637 | Homo sapiens RAB8B, member RAS oncogene family (RAB8B), mRNA [NM_016530] |
| 287 | A_23_P321354 | TMEM71 | AACCACGTTGTCAACCAAGTTTTAATCTCTTGGGGCTCGTAATTACCTTCAGTTAA | SEQ ID NO: 2638 | Homo sapiens transmembrane protein 71 (TMEM71), mRNA 144649] |
| 288 | A_23_P324633 | C9orf72 | TGTGTGGATTTAGTCCCTGGGATTCAGTCGTGTAGAAATGTCTAATAGTCTGTATAGTCC | SEQ ID NO: 2639 | Homo sapiens chromosome 9 open reading frame 72 (C9orf72), transcript variant 1, mRNA [NM_018325] |
| 289 | A_23_P325501 | MORC3 | CATGCCATAAAATACTATGCTTATTGGTCCCATGTTTTGTTGTGCAATTTTAAAGAGATGGC | SEQ ID NO: 2640 | Homo sapiens MORC family CW-type zinc finger 3 (MORC3), mRNA [NM_015358] |
| 290 | A_23_P329198 | OBFC2A | ACATGTCATAAGTGGTACCCACTTCGCCTTTTTACTGTAGGGTGGATAACTGTTAGGATT | SEQ ID NO: 2641 | Homo sapiens oligonucleotide/oligosaccharide-binding fold containing 2A (OBFC2A), mRNA [NM_001031716] |
| 291 | A_23_P330531 | C19orf59 | CTGTCTCCCTGTTTGTGTAAACATAGTAGTATACTGCGGCCGTGTTTCTGTGTCACCGA | SEQ ID NO: 2642 | Homo sapiens chromosome 19 open reading frame 59 (C19orf59), mRNA [NM_174918] |
| 292 | A_23_P332439 | NUPL1 | ATTGAAATCTTGAATGTATTGAATCTGTCAAGGTACAGAGGCGGTGCCTTGTAAATGTC | SEQ ID NO: 2643 | Homo sapiens KIAA0410 mRNA, partial cds. [AB007870] |
| 293 | A_23_P339480 | HAT1 | AACATGAACAGCTCGGAAGGAGAGAGTTTCAGGAAACTAGTTGGAAGATTACCGGCGTGTTATTG | SEQ ID NO: 2644 | Homo sapiens histone acetyltransferase 1 (HAT1), transcript variant 1, mRNA [NM_003642] |
| 294 | A_23_P339554 | MLSTD2 | CAATAACTCGTCTTCAGAAAGCTATAGTGTTTCTTGAATATTGACAAGTAATTCTTGGG | SEQ ID NO: 2645 | Homo sapiens male sterility domain containing 2 (MLSTD2), mRNA [NM_032228] |
| 295 | A_23_P34307 | PIGK | ATTCATTTGACAGTTCTCTATTGTTGGACCACTTACATTGTAAATGTTTCCTTTGG | SEQ ID NO: 2646 | Homo sapiens phosphatidylinositol glycan anchor biosynthesis, class K (PIGK), mRNA [NM_005482] |
| 296 | A_23_P346006 | CCPG1 | TATGGTCGGCACTAATGGAAGACAAATGGGCAAATCTTGAAATAGAATTGGGGCAATTACGT | SEQ ID NO: 2647 | Homo sapiens cell cycle progression 1 (CCPG1), transcript variant 2, mRNA [NM_020739]. |

Fig. 7-17

| No. | Probe ID No. | Symbols of genes | Sequence | SEQ ID NO: | Descriptions of genes (letters and numbers within [ ] indicates GenBank accession No.) |
|---|---|---|---|---|---|
| 297 | A_23_P347059 | MOBKL1A | CTAGAAGGGAAAAATCATCTAAGTTATGAAATCGAACATAGGCG CTATATTACAAACTG | SEQ ID NO: 2849 | Homo sapiens MOB1, Mps One Binder kinase activator-like 1A (yeast) (MOBKL1A), mRNA [NM_173468] |
| 298 | A_23_P34710 | EGLN1 | TGATTGTCAAATGTACAGCCACAGGCCTTTTAATTTGGAGGCCCC TGTTGTCATTCAAAT | SEQ ID NO: 2850 | Egl nine homolog 1 (EC 1.14.11.-) (Hypoxia-inducible factor prolyl hydroxylase 2) (HIF-prolyl hydroxylase 2) (HIF-PH2) (HPH-2) (Prolyl hydroxylase domain-containing protein 2) (PHD2) (SM-20). [Source:Uniprot/SWISSPROT;Acc:Q9GZT9] [ENST00000357180] |
| 299 | A_23_P347198 | SP3 | GACCACCTGAAATTTAAAGGGTACCTTATTGTACGTTTAAAGTGT ATTATAACAGTGTGG | SEQ ID NO: 2851 | Homo sapiens Sp3 transcription factor (SP3), transcript variant 1, mRNA [NM_003111] |
| 300 | A_23_P349083 | FCHO2 | GTGAAATGGTAAACTTCTGGCAGTTCTTCTTAGTTACCACAGTCTTC ATACCAAGTATTGGG | SEQ ID NO: 2852 | Homo sapiens FCH domain only 2 (FCHO2), mRNA [NM_138782] |
| 301 | A_23_P350187 | ENST00000265149 | TTGCTAATATATAGGAATATCAGGTTGACTATATAGGCATACTTGAA AATGCTTCTGAGTGG | SEQ ID NO: 2853 | Homo sapiens mRNA for KIAA1546 protein, partial cds. [AB046766] |
| 302 | A_23_P353704 | RP5-1022P6.2 | TGTCTCTCACTACCTATTACACACTGTTGGCTTTGTGGGTTTGTTT TGTATGTGGGTGTGT | SEQ ID NO: 2854 | Homo sapiens hypothetical protein KIAA1434 (KIAA1434), mRNA [NM_019593] |
| 303 | A_23_P354074 | LYST | GTGGATGTTGTAGGAAACATTTCGTAAATTATCACAAGCTCGT TACCTTTATATAAGC | SEQ ID NO: 2855 | Homo sapiens lysosomal trafficking regulator (LYST), transcript variant 1, mRNA [NM_000081] |
| 304 | A_23_P355067 | TMCO1 | AACTGAAGAACTCTGTTTATTTGTATCATCATTCTTCTAGACACACAC ACATCGAGACTGGCAA | SEQ ID NO: 2856 | Homo sapiens transmembrane and coiled-coil domains 1 (TMCO1), mRNA [NM_019026] |
| 305 | A_23_P355244 | SAMD9 | TCACTGGAGGAAGATTTTCCCTTGCTCTGCATAAATTTAACT CCATAACTTATAAGC | SEQ ID NO: 2857 | Homo sapiens sterile alpha motif domain containing 9 (SAMD9), mRNA [NM_017654] |
| 306 | A_23_P356125 | KIAA1468 | GCACTGCTTTATTACTGCTGCTGTATATTTGTTGATTTGGAGTTA CAACTGTGGTGATAG | SEQ ID NO: 2858 | Homo sapiens KIAA1468 (KIAA1468), mRNA [NM_020854] |
| 307 | A_23_P364107 | C14orf106 | AGGAGACAGTGTTTGTATTTCAAGTGAGTACAGTGTTTCTT TGTAAAGTAGCTTCC | SEQ ID NO: 2859 | Homo sapiens chromosome 14 open reading frame 106 (C14orf106), mRNA [NM_018353] |
| 308 | A_23_P371266 | DNM3 | ACTGTCTTCTTGGCAGTTCAAGCATTTCAGGAGATTTCTTAATGCTGATATATGG ACTCTTAGAATGGAA | SEQ ID NO: 2860 | Homo sapiens dynamin 3 (DNM3), mRNA [NM_015569] |
| 309 | A_23_P37275 | CGRRF1 | GAGGAAGATAAAGACAAAGCGGAAGACTCTTTGAAGACATGGTAAC ACTGAAAAGTACACT | SEQ ID NO: 2861 | Homo sapiens cell growth regulator with ring finger domain 1 (CGRRF1), mRNA [NM_006568] |
| 310 | A_23_P37441 | B2M | TTGCTTTCAGCAAGGACTGGTCTTTCTATCTCTTGTACTACACT GAATTCACGCGGACT | SEQ ID NO: 2862 | Homo sapiens beta-2-microglobulin (B2M), mRNA [NM_004048] |
| 311 | A_23_P378722 | SAT1 | CCATGTACTATTTTACCTATGACCCGGTGGGATTGGGCAAGTTATTGT ATCTGAGGACTGT | SEQ ID NO: 2863 | Homo sapiens spermidine/spermine N1-acetyltransferase 1 (SAT1), mRNA [NM_002970] |
| 312 | A_23_P383764 | CR592K3P | TCCATCTCTGACTTGTTGGAAATTTGGTGAATTATCCAGTCAGAT TCCCGAGTTAGGACC | SEQ ID NO: 2864 | Homo sapiens clone IMAGE:110749 mRNA sequence. [AF143328] |
| 313 | A_23_P38723 | SMCHD1 | ACAAGTACGTGGGCATGGAATTTGCATTTCGATTCAGATGGGACTG GAAACAACCATTCAA | SEQ ID NO: 2865 | Homo sapiens cDNA FLJ44350 fis, clone TRACH3006228. [AK126324] |
| 314 | A_23_P388900 | SLC22A15 | AGGGTAGGCTGGCATCCAGTTGCTTATTCAGATGTGTCACTAAA TTTTCCTTCTAGATG | SEQ ID NO: 2866 | Homo sapiens solute carrier family 22 (organic cation transporter), member 15 (SLC22A15), mRNA [NM_018420] |

Fig. 7-18

| No. | Probe ID No. | Symbols of genes | Sequence | SEQ ID NO: | Descriptions of genes (letters and numbers within [ ] indicate GenBank accession No.) |
|---|---|---|---|---|---|
| 315 | A_23_P390734 | FGFR1OP2 | CCACCAGATACAGAGAAATGTGCTTTAACAATCAGTTGAAACCTAAAT TTTGTTATGTTGTGG | SEQ ID NO: 2667 | Homo sapiens FGFR1 oncogene partner 2 (FGFR1OP2), mRNA [NM_015633] |
| 316 | A_23_P394545 | KIAA1033 | AGCATTTGAATACTATTAATATTCGGCATATTGCTAATTCAATTC GAACACATGGCACGG | SEQ ID NO: 2668 | Homo sapiens KIAA1033 (KIAA1033), mRNA [NM_015275] |
| 317 | A_23_P394605 | SEC24A | GATTTATTTCTTCTAATCAAGATGCATAACAGCTATTATGTAGG GGACCACCAAATGTG | SEQ ID NO: 2669 | Homo sapiens SEC24 related gene family, member A (S. cerevisiae) (SEC24A), mRNA [NM_021982] |
| 318 | A_23_P396353 | NIN | ATCTTGCAGGTCTAGTATTTAATAATGCACTATTACCCAGGGGA GATATTGAGAAAC | SEQ ID NO: 2670 | Homo sapiens ninein (GSK3B interacting protein) (NIN), transcript variant 2, mRNA [NM_020921] |
| 319 | A_23_P398073 | PPM1B | GGTTCAGTAACTTTTCATTTTATAACATTGGGACGGATACAAGAGT GATTGTCACATAAGG | SEQ ID NO: 2671 | Homo sapiens protein phosphatase 1B (formerly 2C), magnesium-dependent, beta isoform (PPM1B), transcript variant 2, mRNA [NM_177968] |
| 320 | A_23_P398449 | VNN3 | ACATATCAATTGTGACCCCAGAAGAATGGAATCTATGGTTGGATGTT CACCAGGGAAGAGCAT | SEQ ID NO: 2672 | Homo sapiens vanin 3 (VNN3), transcript variant 2, mRNA [NM_078625] |
| 321 | A_23_P40108 | COL9A3 | TCAAAAGGCCCTAGCTAATAAACCTGTAAGCCAGGCATTTGAGAG AAGGTAGGGTGTGTA | SEQ ID NO: 2673 | Homo sapiens collagen, type IX, alpha 3 (COL9A3), mRNA [NM_001853] |
| 322 | A_23_P405873 | C9orf72 | GAGAATGGAAGATCAGAGGTCAGAGTATTATTCCAATGCTTACTGG AGAAGTGATTCCTGT | SEQ ID NO: 2674 | Homo sapiens chromosome 9 open reading frame 72 (C9orf72), transcript variant 2, mRNA [NM_145005] |
| 323 | A_23_P406986 | MOSPD2 | TTACTATTCTGAAGGGTAGTGTGTTGGTTTTCATCTTCAAGAAG TTGATTCCAAAAGTG | SEQ ID NO: 2675 | Homo sapiens motile sperm domain containing 2 (MOSPD2), mRNA [NM_152581] |
| 324 | A_23_P4096 | CA4 | TAATATCCCAAACCTGAGATGAGCACTAGCATGGCAGAGAGCAG GCTGTTGGACCTGCT | SEQ ID NO: 2676 | Homo sapiens carbonic anhydrase IV (CA4), mRNA [NM_000717] |
| 325 | A_23_P41114 | CSTA | AAACAAATGAGACTTATGCAGAAAATTGGAAGCTGTGCAGTATAAA CTCAAGTTGTTGCTG | SEQ ID NO: 2677 | Homo sapiens cystatin A (stefin A) (CSTA), mRNA [NM_005213] |
| 326 | A_23_P412980 | SNX13 | CCCGATCTCAAGCAACAAGAATGGGGTTGGTTTCTTCCATTTCAAACT AATCAGCATGTCCA | SEQ ID NO: 2678 | Homo sapiens sorting nexin 13 (SNX13), mRNA [NM_015132] |
| 327 | A_23_P41645 | ELL2 | TGTCTTTTCAAAGTGCTGCCAGTTGAAAGGGAAGCATTATGTTT ACAAATCTCTTTTGA | SEQ ID NO: 2679 | Homo sapiens elongation factor, RNA polymerase II, 2 (ELL2), mRNA [NM_012081] |
| 328 | A_23_P41664 | ENST00000334994 | TGGCTTGGAAGCAGATTCGACTTCATAAACAAATTGTTCCTGAAAA TGAGGCACAGGTCAT | SEQ ID NO: 2680 | Synleurin (GGL01891) [Source:Uniprot/SPTREMBL;Acc:Q72207] [ENST00000334994] |
| 329 | A_23_P420431 | XKR3 | CAGAGGTGGGGCCATAGAATCGTACACGTACACGCTTCAGTTTTTT AGAAAATGTGATAAT | SEQ ID NO: 2681 | Homo sapiens XK, Kell blood group complex subunit-related family, member 3 (XKR3), mRNA [NM_175878] |
| 330 | A_23_P422083 | TMEM55A | AAATTTATGGAATCAGGTCTGCTGCACTGCCATCTTTGGAGTTTTG AAAAGAAATTGCTT | SEQ ID NO: 2682 | Homo sapiens transmembrane protein 55A (TMEM55A), mRNA [NM_018710] |
| 331 | A_23_P424080 | YIPF4 | AAAGGATTGTGTTTTTAAGATTGTGTGGATATTCACCTAAAACT TGTGCCAAAAGCAGC | SEQ ID NO: 2683 | Homo sapiens Yip1 domain family, member 4 (YIPF4), mRNA [NM_032312] |
| 332 | A_23_P427217 | JMJD1C | TCCAGAACATCTTGTAGAGTGCATTTCATTTAACAGAGGAACTGAG ACTTTGAAGGAAGA | SEQ ID NO: 2684 | Homo sapiens jumonji domain containing 1C (JMJD1C), transcript variant 2, mRNA [NM_004241] |
| 333 | A_23_P429491 | FLJ25416 | GCTTGGTCACCCGAATTGTTTTCATAAAAGTCACCTGAACCGAA TTGCTGAACTTTTAA | SEQ ID NO: 2685 | Homo sapiens hypothetical protein FLJ25416 (FLJ25416), mRNA [NM_145018] |
| 334 | A_23_P429689 | FAM44A | ACCAATACTCTTTCGCATATTCTCTTTTTCAGTGAAGAGAAATGCA TTCAAGATTAGGTCC | SEQ ID NO: 2686 | Homo sapiens family with sequence similarity 44, member A (FAM44A), mRNA [NM_148894] |

Fig. 7-19

| No | Probe ID No. | Symbols of genes | Sequence | SEQ ID NO: | Descriptions of genes (letters and numbers within [ ] indicates GenBank accession No.) |
|---|---|---|---|---|---|
| 335 | A_23_P42969 | FGL2 | TTCAGGCTGGTGGTTTGATGCATGCTTTCTGCAAAGTTAAATGGCAAATATTATCACCA | SEQ ID NO: 2687 | Homo sapiens fibrinogen-like 2 (FGL2), mRNA [NM_006682] |
| 336 | A_23_P42975 | PRKAR2B | GCCACATTTTTAGAACACTGTTTAAGCAATTTTTGGAAAACCTTGTTGTAGGAAAAGAGAGC | SEQ ID NO: 2688 | Homo sapiens protein kinase, cAMP-dependent, regulatory, type II, beta (PRKAR2B), mRNA [NM_002736] |
| 337 | A_23_P430161 | EXOC8 | AAGTACAGGATTTTCTTCAGGTAAAATCTGTGTTCCAATTACAGTTGTAGGTCAAGGA | SEQ ID NO: 2689 | Homo sapiens exocyst complex component 8 (EXOC8), mRNA [NM_175876] |
| 338 | A_23_P431630 | USP32 | CCCATACCCTTTCTTCCTCATAGATAGTAATTACCAATGTAAGTAAGTATTGTGTCTG | SEQ ID NO: 2690 | Homo sapiens ubiquitin specific peptidase 32 (USP32), mRNA [NM_032582] |
| 339 | A_23_P434609 | S100A8 | AAAGGGATGAAGAAAGCCACAAAGAGATAGCTGAGTTACTGGGCCAGAGGCTGGGCCCCT | SEQ ID NO: 2691 | Homo sapiens S100 calcium binding protein A8 (S100A8), mRNA [NM_002964] |
| 340 | A_23_P44257 | COMMD8 | AACATTTACTTCTGCGCTTCTCATGTGTTGGGAAACATTGGTGTGATAAAAATAGGTGTC | SEQ ID NO: 2692 | Homo sapiens COMM domain containing 8 (COMMD8), mRNA [NM_017845] |
| 341 | A_23_P44768 | TBK1 | TCTACTCTGAGTGGGGGGTAAATAAGTTATTTTGTCTGACGGCCTAGTGGAAATATTTTA | SEQ ID NO: 2693 | Homo sapiens TANK-binding kinase 1 (TBK1), mRNA [NM_013254] |
| 342 | A_23_P46141 | CTSS | TCTGTTGGTGTGTAGATGCGGTCATCCTGTTCTTCCTCTACAGAAGTGGTGTCTACTAT | SEQ ID NO: 2694 | Homo sapiens cathepsin S (CTSS), mRNA [NM_004079] |
| 343 | A_23_P46396 | PTBP2 | AACCAAGGTGGGACCCAAAGTTTATGTGCTTTAGTCTTAATTTACCTTCCATTGTAATATT | SEQ ID NO: 2695 | Homo sapiens polypyrimidine tract binding protein 2 (PTBP2), mRNA [NM_021190] |
| 344 | A_23_P48166 | TWF1 | TGGAACCAGACCATAGCTGAAGCTGTTATTTCAGTCAGGAAGAAGCTACCTTGCATGAAGGT | SEQ ID NO: 2696 | Homo sapiens twinfilin, actin-binding protein, homolog 1 (Drosophila) (TWF1), mRNA [NM_002822] |
| 345 | A_23_P48897 | CCPG1 | AAGTCAGAAGGTCATACATATAATTCTAATGTCCAACTATGTCCATTCCATGTACCA | SEQ ID NO: 2697 | Homo sapiens cell cycle progression restoration protein (CPR8) mRNA, complete cds. [AF011794] |
| 346 | A_23_P50108 | NDC80 | AAAGTGGGAAATAACTTCGAACGTCTGTTAGAGATGGTCGTACACATGTTGGGTCTGTA | SEQ ID NO: 2698 | Homo sapiens NDC80 homolog, kinetochore complex component (S. cerevisiae) (NDC80), mRNA [NM_006101] |
| 347 | A_23_P502797 | WDFY1 | GTAACAGTTTACTGGTTGTTCCATTCCTGAATATGCAGGGTAATTTGTACAGATAGGGAT | SEQ ID NO: 2699 | Homo sapiens WD repeat and FYVE domain containing 1 (WDFY1), mRNA [NM_020830] |
| 348 | A_23_P50907 | ITGAV | AAAGAGTGATTAAGTGAGGTTATTTACCCGCTAAATGGTCCATTCTGCCATTGTATTTCAGG | SEQ ID NO: 2700 | Homo sapiens integrin, alpha V (vitronectin receptor, alpha polypeptide, antigen CD51) (ITGAV), mRNA [NM_002210] |
| 349 | A_23_P50974 | HECW2 | GAGAAAGATGAACCCATACATGATCAGGTCCACGGTAATTTTTAGGGACTCAGGAGAATC | SEQ ID NO: 2701 | Homo sapiens HECT, C2 and WW domain containing E3 ubiquitin protein ligase 2 (HECW2), mRNA [NM_020760] |
| 350 | A_23_P51009 | NDUFB3 | CCGCAATGAAGCTTGGAGATACATGGGTGGCTTGCAAAGAGAGTGTTTGCTTTTCTGATGT | SEQ ID NO: 2702 | Homo sapiens NADH dehydrogenase (ubiquinone) 1 beta subcomplex, 3, 12kDa (NDUFB3), mRNA [NM_002491] |
| 351 | A_23_P51996 | STXBP3 | ATTCAGTGATTAATAGAAATGGAGTGATTTGACAGTGTGTACTGTTTTGCCACATACTTG | SEQ ID NO: 2703 | Homo sapiens syntaxin binding protein 3 (STXBP3), mRNA [NM_007269] |
| 352 | A_23_P53467 | IKIP | GTTAGAACCATTAGTAAATGATTTAACACTACGCATTGGGAGATTGGTTACCGAGTAC | SEQ ID NO: 2704 | Homo sapiens IKK interacting protein (IKIP), transcript variant 2, mRNA [NM_201612] |
| 353 | A_23_P53668 | NFYB | TGGGTCATATTGTGCATACCATTTGTAACCTGCTTTTTCACTTAACAATATATGGG | SEQ ID NO: 2705 | Homo sapiens nuclear transcription factor Y, beta (NFYB), mRNA [NM_006166] |

Fig. 7-20

| No. | Probe ID No. | Symbols of genes | Sequence | SEQ ID NO: | Descriptions of genes (letters and numbers within [ ] indicates GenBank accession No.) |
|---|---|---|---|---|---|
| 354 | A_23_P53891 | KLF5 | CGTTGAATTGATGATGCAGTTTTCATATATCGAGATGTTCGGTCGTGACAGTACTGTTGGT | SEQ ID NO: 2706 | Homo sapiens Kruppel-like factor 5 (intestinal) (KLF5), mRNA [NM_001730] |
| 355 | A_23_P5611 | RIF1 | ATGTATTCTTGGGTCGGTATGGGTGGTTTTCAGGAAATTAATTATCTTACTGAGTGTG | SEQ ID NO: 2707 | Homo sapiens RAP1 interacting factor homolog (yeast) (RIF1), mRNA [NM_018151] |
| 356 | A_23_P56734 | HNMT | CCTTTGTCCACCATGGATATCTGACTGCTTATTGATGGTAATGAAAATGGAGAACCT | SEQ ID NO: 2708 | Homo sapiens histamine N-methyltransferase (HNMT), transcript variant 1, mRNA [NM_006895] |
| 357 | A_23_P56759 | KRCC1 | GATATCGGTGTTCATACCAGTTTTCTTATGTGAATAGGTCTTTAACTCTAACAAAGGC | SEQ ID NO: 2709 | Homo sapiens lysine-rich coiled-coil 1 (KRCC1), mRNA [NM_016618] |
| 358 | A_23_P57658 | HRASLS | TTGGGAGGAGGAAAAGAAAACCTGGGGTGAATACTTATTTTCAGTGCATCATTACTGTTCC | SEQ ID NO: 2710 | Homo sapiens HRAS-like suppressor (HRASLS), mRNA [NM_020386] |
| 359 | A_23_P57856 | BCL6 | CTGGTTAAAGGCTCAGATTTTGTATCTGCAGGCAGGACGAAACGGATCTGAGAATCTTTATTGA | SEQ ID NO: 2711 | Homo sapiens B-cell CLL/lymphoma 6 (zinc finger protein 51) (BCL6), transcript variant 2, mRNA [NM_138931] |
| 360 | A_23_P58390 | C4orf32 | TAATACTAACTATTTAGTATACTGTCAGTACTGTGTACATCTGGACACTGGTGTTAATAGGG | SEQ ID NO: 2712 | Homo sapiens chromosome 4 open reading frame 32 (C4orf32), mRNA [NM_152400] |
| 361 | A_23_P58912 | SLC35A1 | ATGATCAGTGCGGGTTATGTGGAAACAACGAACAAACAACGAAGCTATCTGAGTGAACTGC | SEQ ID NO: 2713 | Homo sapiens solute carrier family 35 (CMP-sialic acid transporter), member A1 (SLC35A1), mRNA [NM_006416] |
| 362 | A_23_P59637 | DOCK4 | TTTGGCAGTGAGGAGGGTTCAATTTATCTTGAATTTATCATCATGTGTGTATTTCTGAAGCAG | SEQ ID NO: 2714 | Homo sapiens dedicator of cytokinesis 4 (DOCK4), mRNA [NM_014705] |
| 363 | A_23_P58921 | SUB1 | CAGATTGGGAAATGAGGTACGTTAGTGTTCGGCATTTTAAAGGCAAAGTGCTAATTGAT | SEQ ID NO: 2715 | Homo sapiens SUB1 homolog (S. cerevisiae) (SUB1), mRNA [NM_006713] |
| 364 | A_23_P63896 | ZNF354A | AAACGAAAAGGTCATCGAACAGACATCCTTGAGAGAGAGTGTAATAAATGTATGACATGT | SEQ ID NO: 2716 | Homo sapiens zinc finger protein 354A (ZNF354A), mRNA [NM_005649] |
| 365 | A_23_P61674 | CLK4 | GAAAAGGCATGCAGTTTTGTCCATTGTGACAGTTTGTTTAATAAAACCAGATACACACTTTA | SEQ ID NO: 2717 | Homo sapiens CDC-like kinase 4 (CLK4), mRNA [NM_020666] |
| 366 | A_23_P62227 | CXorf21 | AGGAACACTTTATCCATTTATTCTGAGAATGATGCAGGAAGGGGTTAGTGAAGGGGAATTAA | SEQ ID NO: 2718 | Homo sapiens chromosome X open reading frame 21 (CXorf21), mRNA [NM_025159] |
| 367 | A_23_P63343 | UTS2 | AGAATCTGGAAAGCATACAAGAAGAATGAGAGACTCCTGATTGCTTCTCGAAATACTGTGTC | SEQ ID NO: 2719 | Homo sapiens urotensin 2 (UTS2), transcript variant 1, mRNA [NM_021995] |
| 368 | A_23_P63655 | ATP5C1 | AGAGAGCTGAAACGAGCTCGAATATATGGATCTTAGCTCTGTATGAAAAAGCT | SEQ ID NO: 2720 | Homo sapiens ATP synthase, H+ transporting, mitochondrial F1 complex, gamma polypeptide 1 (ATP5C1), nuclear gene encoding mitochondrial protein, transcript variant 2, mRNA [NM_005174] |
| 369 | A_23_P63896 | FAS | ATGTCTATCCACAGGGTCAACCCCACTCTATGAATCAATAGAAGAAGCTATGACCTTTGC | SEQ ID NO: 2721 | Homo sapiens Fas (TNF receptor superfamily, member 6) (FAS), transcript variant 1, mRNA [NM_000043] |
| 370 | A_23_P65262 | RP11-298P3.3 | AGCCAAGAGTTAAGCAAGCACTGACTACCGTTCCCTTGAGCTACCATTATCACAAAGGGTTT | SEQ ID NO: 2722 | Human BRCA2 region, mRNA sequence CG016. [U50529] |
| 371 | A_23_P65768 | C15orf15 | TCCTGGATTGCCATCTACATAATAATCGAGATATTACGGATGTTAGATTGCATCGAGTGTT | SEQ ID NO: 2723 | Homo sapiens chromosome 15 open reading frame 15 (C15orf15), mRNA [NM_016304] |
| 372 | A_23_P66260 | ZNF267 | TGTGATGAATGTGGTAAGGCTTCAGCTATAGGTCATACCTCACTACACATGGAGAAGT | SEQ ID NO: 2724 | Homo sapiens zinc finger protein 267 (ZNF267), transcript variant 498723, mRNA [NM_003414] |

Fig. 7-21

| No. | Probe ID No. | Symbols of genes | Sequence | SEQ ID NO: | Descriptions of genes (letters and numbers within [ ] indicates GenBank accession No.) |
|---|---|---|---|---|---|
| 373 | A_23_P68472 | DPM1 | CTATTGGGAGGTTCCAATATCATTTGTGATGGTGTTTATGGTG AATCCAAGTTGGGAG | SEQ ID NO: 2725 | Homo sapiens dolichyl-phosphate mannosyltransferase polypeptide 1, catalytic subunit (DPM1), mRNA [NM_003859] |
| 374 | A_23_P69109 | PLSCR1 | GTTAGCTCTTAGACTGTCTATCCTTCCTAGAGAAATGGTAATTGAGA TTACTGAGATATTAA | SEQ ID NO: 2726 | Homo sapiens phospholipid scramblase 1 (PLSCR1), mRNA [NM_021105] |
| 375 | A_23_P6914 | OSBPL11 | GGTCTTCCAATCAGTGTGTGTAACATACCTGTTGTTTATCAGGCA TTGTAGGTGGGTGTG | SEQ ID NO: 2727 | Homo sapiens oxysterol binding protein-like 11 (OSBPL11), mRNA [NM_022776] |
| 376 | A_23_P69908 | GLRX | CTGATAAAACTTAGAGCCCCTACACCAAGAGTGTATGTGTGAAA GAGCTCCTACAGTT | SEQ ID NO: 2728 | Homo sapiens glutaredoxin (thioltransferase) (GLRX), mRNA [NM_002064] |
| 377 | A_23_P70290 | TMEM30A | ATCTTCTCCTCCAACTGTGTAAAGCACATGTAAGTGCTTAATGGAGA CTGTTTTCATTCTG | SEQ ID NO: 2729 | Homo sapiens transmembrane protein 30A (TMEM30A), mRNA [NM_018247] |
| 378 | A_23_P70297 | ANKRD6 | CCTTGTTTGTGGAGTCAAGTGTTGATATACTTGAGGGATGATTATG TGTCTTCTAATTAAT | SEQ ID NO: 2730 | Homo sapiens mRNA for KIAA0957 protein, partial cds. [AB023174] |
| 379 | A_23_P70326 | CENPQ | CAATGGCTTACAGTTTCTGTCTCGTCATCTGGAAACTTGAAAAATC CTCAAATGCTTCAC | SEQ ID NO: 2731 | Homo sapiens centromere protein Q (CENPQ), mRNA [NM_018132] |
| 380 | A_23_P70938 | STARD3NL | GCATTATGTGTATGGGCCTGAAGTGTTGGAGCTTGCAAAAGGGGAAG AAAGGAATTGGAAT | SEQ ID NO: 2732 | Homo sapiens STARD3 N-terminal like (STARD3NL), mRNA [NM_032016] |
| 381 | A_23_P71430 | UBE2W | AAATTGTTGAAAGGTCCAAGTCTCAGTACCATGTGAGTAATGAT AGTACAACTAAGTTG | SEQ ID NO: 2733 | Homo sapiens ubiquitin-conjugating enzyme E2W (putative) (UBE2W), transcript variant 1, mRNA [NM_001001481] |
| 382 | A_23_P71433 | UBE2W | CATGAGCGCTACTGGCTAAACACTATTCATTATTATGTTTGG AAACGCCCGTAAAGAT | SEQ ID NO: 2734 | Homo sapiens ubiquitin-conjugating enzyme E2W (putative) (UBE2W), transcript variant 1, mRNA [NM_001001481] |
| 383 | A_23_P72503 | KLHL2 | TTTTTGATATTTAACAATGCTTAAACACTTAAATGCCAGTTGTGA GGAATGGACCTGGTG | SEQ ID NO: 2735 | Homo sapiens kelch-like 2, Mayven (Drosophila) (KLHL2), mRNA [NM_007246] |
| 384 | A_23_P7262 | MARCH1 | GATTATTGTGTTCTTTGGATATTCATATGTAAAACTGATGTGTGAAT GACATTGCAGTGAGC | SEQ ID NO: 2736 | Homo sapiens cDNA FLJ20608 fis, clone KAIA585. [AK000675] |
| 385 | A_23_P7282 | ELMOD2 | TTCAAGTAGGTTTCTCTGGGGAAAAGTACCACTTGGACACTTA AAGGAATTGGGATTT | SEQ ID NO: 2737 | ELMO domain-containing protein 2. [Source:Uniprot/SWISSPROT:Acc:Q8IZ81] [ENST00000323570] |
| 386 | A_23_P74001 | S100A12 | TGAAGGCTTTTTACCGAGCAATGATGTCCTCAATGAGGGTCTTTTGTT TCCCTCACCAAAACC | SEQ ID NO: 2738 | Homo sapiens S100 calcium binding protein A12 (S100A12), mRNA [NM_005621] |
| 387 | A_23_P75028 | REEP3 | AGAAACAGCACACAAGTGTATTTTAGTCATCTACACGTCAAATAT CCCAAGACAGATAT | SEQ ID NO: 2739 | Homo sapiens receptor accessory protein 3 (REEP3), mRNA [NM_001013390] |
| 388 | A_23_P7543 | ZFYVE16 | TCTGCCTCAGCATTATGTAACCTAAATGATCTTGATAGTGCTGATACC TGTGATCCATGGTGG | SEQ ID NO: 2740 | Homo sapiens zinc finger, FYVE domain containing 16 (ZFYVE16), mRNA [NM_014733] |
| 389 | A_23_P75769 | MS4A4A | CACCAAAAGATCAACAGACAAAATGCTCCAGAAATGTATGCTGACT GTGACAAGAGCCT | SEQ ID NO: 2741 | Homo sapiens membrane-spanning 4-domains, subfamily A, member 4 (MS4A4A), transcript variant 1, mRNA [NM_024021] |
| 390 | A_23_P76480 | BF213738 | AAATCGAACAGGACAATGGGTAGAGTTTACCAAATC GTTTGGATCGAGAGG | SEQ ID NO: 2742 | BF213738 601847628F1 NIH_MGC_55 Homo sapiens cDNA clone IMAGE:4078519 5', mRNA sequence [BF213738] |

Fig. 7-22

| No. | Probe ID No. | Symbols of genes | Sequence | SEQ ID NO: | Descriptors of genes (letters and numbers within [ ] indicates GenBank accession No.) |
|---|---|---|---|---|---|
| 391 | A_23_P76799 | BAZ1A | TACAACATGAATGAATCCAATCTTATAACCTTGAAGTGCTGTACCAGTGCTGGCTGCAGGT | SEQ ID NO: 2743 | Homo sapiens bromodomain adjacent to zinc finger domain, 1A (BAZ1A), transcript variant 1, mRNA [NM_013448] |
| 392 | A_23_P76951 | TXNDC1 | ATTTCTGTAATGTCCCCTTCTTCTAGGCTGCTGTTGCTGTGTGAATCCATTAAGATTTACA | SEQ ID NO: 2744 | Homo sapiens thioredoxin domain containing 1 (TXNDC1), mRNA [NM_030755] |
| 393 | A_23_P77286 | C15orf29 | TGGTTTAGAGTTAATGCTGATCTGTGTATTTTAAATTCCAAGACTTTGTGTCAGCTACCTGC | SEQ ID NO: 2745 | Homo sapiens chromosome 15 open reading frame 29 (C15orf29), mRNA [NM_024713] |
| 394 | A_23_P78092 | EVI2A | GCTGAATCAGAGACTTGAAAAGAACAAAGAGCTCAGAGGACCCAACCTAGTGATGCAA | SEQ ID NO: 2746 | Homo sapiens ecotropic viral integration site 2A (EVI2A), transcript variant 1, mRNA [NM_001003927] |
| 395 | A_23_P81248 | TAF7 | TGCTAGTTGCATATGTTTTCCTATGCAATAGTTGTTTGTTTTCCCAGTTATTCAAAGGCAGCTT | SEQ ID NO: 2747 | Homo sapiens TAF7 RNA polymerase II, TATA box binding protein (TBP)-associated factor, 55kDa (TAF7), mRNA [NM_005642] |
| 396 | A_23_P82047 | BU507302 | TCTGTTTCGTTAATGTCAGCTGGCTGAACATTGAGCAGTTTATAAATTGCTTAATTTGTG | SEQ ID NO: 2748 | AGENCOURT_10309688 NIH_MGC_71 Homo sapiens cDNA clone IMAGE:6501220 5'. mRNA sequence [BU507302] |
| 397 | A_23_P8281 | IFNGR1 | CTTTACATCCAGATAGGTTACCAGTAACGGAAGAGTATCCAGTACTCCTGGTTCCTAGGT | SEQ ID NO: 2749 | Homo sapiens interferon gamma receptor 1 (IFNGR1), mRNA [NM_000416] |
| 398 | A_23_P83073 | HIATL1 | AAACAACTCAAGACTGTGGTGGCAACATAGAGATTGTAGGGTGCTTCTAAGAAAGTTAT | SEQ ID NO: 2750 | Homo sapiens hippocampus abundant transcript-like 1 (HIATL1), mRNA [NM_032558] |
| 399 | A_23_P83094 | TLE4 | ACCTCCCTCTGAAAAACAACACAAGAATGGACTCTCTCCTAGGATGAGGACTTGCTTCTT | SEQ ID NO: 2751 | Homo sapiens transducin-like enhancer of split 4 (E(sp1) homolog, Drosophila) (TLE4), mRNA [NM_007005] |
| 400 | A_23_P83175 | PTPLAD2 | CATGCTCTTTTGTGTGGTGATCACCAGTCAAGAGGAAGTCCAAGAGAAATATGTGTGTGT | SEQ ID NO: 2752 | Homo sapiens protein tyrosine phosphatase-like A domain containing 2 (PTPLAD2), mRNA [NM_001010915] |
| 401 | A_23_P83278 | CHMP5 | CATTGCTCTTTATTTTTCCATTAAGAGACTCATTGCTTGCGGAAATGCTTCGTTCGTATG | SEQ ID NO: 2753 | Homo sapiens chromatin modifying protein 5 (CHMP5), mRNA [NM_016410] |
| 402 | A_23_P84070 | LARP7 | TGATTTGCTAGAAGGGATACAGAGAATGCCATGCTAGATTTAAGACTCCTGAGGATGCTCA | SEQ ID NO: 2754 | Homo sapiens La ribonucleoprotein domain family, member 7 (LARP7), transcript variant 1, mRNA [NM_016648] |
| 403 | A_23_P8513 | SNX10 | TTTAAGAGCGAATCTCATCCCTTCAGCAATTGATTTGAGTTCACACTATTCTGTTT | SEQ ID NO: 2755 | Homo sapiens sorting nexin 10 (SNX10), mRNA [NM_013322] |
| 404 | A_23_P86853 | SRGN | AGGACTTGGGTCAACATGAATTAGGAAGAGGATTTTATGTTATAAAAGAGGATTTTCCCAC | SEQ ID NO: 2756 | Homo sapiens serglycin (SRGN), mRNA [NM_002727] |
| 405 | A_23_P87879 | CD69 | TGTGAAATATGGTGAGTGTGGGAAATGTCTCATTAGGAAATATCTGTAATCTTCAGACCTAG | SEQ ID NO: 2757 | Homo sapiens CD69 molecule (CD69), mRNA [NM_001781] |
| 406 | A_23_P89755 | RNF138 | TGTGACCGTGATATAGTGAGAAAGATTGTACGAACCACTGTTTCACTACTTTTTAGTTAA | SEQ ID NO: 2758 | Homo sapiens ring finger protein 138 (RNF138), transcript variant 1, mRNA [NM_016271] |
| 407 | A_23_P9056 | RB1CC1 | TTGATTTTCTCAAGGGCATACCTTGTGCATTGGCTTATGATGAGCCATATTAATTGC | SEQ ID NO: 2759 | Homo sapiens RB1-inducible coiled-coil 1 (RB1CC1), mRNA [NM_014781] |
| 408 | A_23_P91346 | BC008667 | GGGCTTAGGAGTGAGATTTCTGGTCTACAGAAATGATGATGCTGAATGAATTTTGACATTT | SEQ ID NO: 2760 | Homo sapiens cDNA clone MGC:17708 IMAGE:3368595, complete cds. [BC008667] |

Fig. 7-23

| No. | Probe ID No. | Symbols of genes | Sequence | SEQ ID NO: | Descriptions of genes (letters and numbers within [ ] indicates GenBank accession No.) |
|---|---|---|---|---|---|
| 409 | A_23_P92410 | CASP3 | TGCACCAAGTCTCACTGGCTGGTCAGTATGACATTTCACGGGAGAATTTCTTGTTGTCGAA | SEQ ID NO: 2761 | Homo sapiens caspase 3, apoptosis-related cysteine peptidase (CASP3), transcript variant alpha, mRNA [NM_004346] |
| 410 | A_23_P94216 | LONRF1 | GGGTCATTTATTGCCCAAGTTTAGAAGAGTAGGATACAAGTTTTTGCAAATTGAATTTG | SEQ ID NO: 2762 | Homo sapiens LON peptidase N-terminal domain and ring finger 1 (LONRF1), mRNA [NM_152271] |
| 411 | A_23_P94230 | LY96 | TGAAGTCATTTCTGGGAGCCAGAAGAAATGCTCTTTGCTTGGAGTTTGTCATCCTACA | SEQ ID NO: 2763 | Homo sapiens lymphocyte antigen 96 (LY96), mRNA [NM_015364] |
| 412 | A_23_P94501 | ANXA1 | GGCTCTTTGTGGAGGAAAGTAAACATTCCCTTGATGGTCTGAAGCTATGATCGAAGACT | SEQ ID NO: 2764 | Homo sapiens annexin A1 (ANXA1), mRNA [NM_000700] |
| 413 | A_23_P95130 | SLC37A3 | TTGAGGGATACCTAATTTGCATTCGGTTAGGGGATATTTTCAACCTCTTGCTTTATACT | SEQ ID NO: 2765 | Homo sapiens solute carrier family 37 (glycerol-3-phosphate transporter), member 3 (SLC37A3), transcript variant 1, mRNA [NM_207113] |
| 414 | A_23_P95594 | NAT1 | TCCTTGGAGAGAAAGTTGTGCCCAAACATGGTCATGATAGATTTTTACTATTTAGAATAAG | SEQ ID NO: 2766 | Homo sapiens N-acetyltransferase 1 (arylamine N-acetyltransferase) (NAT1), mRNA [NM_000662] |
| 415 | A_23_P9574 | ECT2 | TAATAGTTACTGACTATAGATTGTTTCTATGCCATGTATGTGCCACTTCTGAGAGTAG | SEQ ID NO: 2767 | Homo sapiens epithelial cell transforming sequence 2 oncogene (ECT2), mRNA [NM_018098] |
| 416 | A_23_P98085 | PTEN | ACAGCAACAATGACTTAACCATATAAATGTGGAGGCTATCAAGAAAGAATGGGCTTGAAA | SEQ ID NO: 2768 | Homo sapiens phosphatase and tensin homolog (mutated in multiple advanced cancers 1) (PTEN), mRNA [NM_000314] |
| 417 | A_23_P98382 | TIMM8B | TTGTTACTAAGCAGATTTAAGGGTCAGTGGGGGAAGGCTATCAACCCATTGTCGATCAG | SEQ ID NO: 2769 | Homo sapiens translocase of inner mitochondrial membrane 8 homolog B (yeast) (TIMM8B), mRNA [NM_012459] |
| 418 | A_23_P98930 | C12orf35 | GCCATGTCTTGAGGGAGGACCGTTCCTCAGTTAAGGACTTGTTTATTTAAATGGGACTGTAA | SEQ ID NO: 2770 | Homo sapiens chromosome 12 open reading frame 35 (C12orf35), mRNA [NM_018169] |
| 419 | A_23_P99163 | DRAM | GGTCACGATGGAGTTTCATGCTTCATTTCACATCTCTCTGCACAATTAGATGGGAGCT | SEQ ID NO: 2771 | Homo sapiens damage-regulated autophagy modulator (DRAM), mRNA [NM_018370] |
| 420 | A_23_P99405 | ZMYM2 | GCTGGGTATACCATGTAAATATCGTGAGTGAAAGTTGCCATTATTGTATGTAGTGGT | SEQ ID NO: 2772 | Homo sapiens zinc finger, MYM-type 2 (ZMYM2), mRNA [NM_003453] |
| 421 | A_23_P99442 | FLT3 | CGTGTGGGTTTAGTCTTGTTTGTTTCAAAAGGGACTTTGTAAAATGAAATCGTCGTCACAA | SEQ ID NO: 2773 | Homo sapiens fms-related tyrosine kinase 3 (FLT3), mRNA [NM_004119] |
| 422 | A_23_P99853 | KIAA1370 | CTTTTGTACTGTTGAAACCACTTGTTGTAATTTCAGGAGGAATATAAAAGCCCCAGTTAG | SEQ ID NO: 2774 | Homo sapiens KIAA1370 (KIAA1370), mRNA [NM_019600] |
| 423 | A_23_P99880 | HMGB1 | GGATTCTTCCATTTGCATTTGTAATTTCAGGAGGAATACTGAACATCTGAGTC | SEQ ID NO: 2775 | Homo sapiens high-mobility group box 1 (HMGB1), mRNA [NM_002128] |
| 424 | A_23_P99985 | HMGB1 | TGGGGCAAGCTTTTCAAACAAAGATGCGACATTCAAAATAGGGTATATTTTCCTATTAC | SEQ ID NO: 2776 | Homo sapiens high-mobility group box 1 (HMGB1), mRNA [NM_002128] |
| 425 | A_23_P100387 | GK | TAAAAGGTCTGTTTGTTTGGAATCAATGATAGCTTATTGACTGTTCTGAATTGTGCTG | SEQ ID NO: 2777 | Homo sapiens glycerol kinase (GK), transcript variant 1, mRNA [NM_203391] |
| 426 | A_23_P105848 | BX111927 | TTATGAGATGCTTCAGTTCAAATAACAGTGCAGTAATTCACGTATATCTAAAAGACTGCC | SEQ ID NO: 2778 | BX111927 Soares_multiple_sclerosis_2NbHMSP Homo sapiens cDNA clone IMAGp998G05619, mRNA sequence [BX111927] |
| 427 | A_24_P105913 | THC2606573 | CTGTGCTCTAGGAAATGACCAATACCAAAGGTCAATGTGGAAATATGGGCATGTTTGCC | SEQ ID NO: 2779 | AY151386 NAP1 [Homo sapiens] (exp=0; wgp=0; cg=0), partial (35%) [THC2606573] |

Fig. 7-24

| No. | Probe ID No. | Symbols of genes | Sequence | SEQ ID NO: | Descriptions of genes (letters and numbers within [ ] indicate GenBank accession No.) |
|---|---|---|---|---|---|
| 428 | A_24_P107257 | LIN7C | TATTAGTAGTGGGACTGTGACTGAGGTCTTAAAGACTGAAAGAGTT GGGGTTCATTTCTG | SEQ ID NO: 2780 | Homo sapiens lin-7 homolog C (C. elegans) (LIN7C), mRNA [NM_018362] |
| 429 | A_24_P11045 | THC2785765 | CCACCAGAAACGTACACCTGATTTTCATGACAAATACGGTAGCAA CACAAGTCGGAATAG | SEQ ID NO: 2781 | COX7B_HUMAN (P24311) Cytochrome c oxidase polypeptide VIIb, mitochondrial precursor partial (78%) [THC2785765] |
| 430 | A_24_P114249 | GALNT3 | ATTTCAAATCGAGAATACTTGACTCATTTAAAGCTAAATTTTGTT ACTGATTCAATTATA | SEQ ID NO: 2782 | Homo sapiens UDP-N-acetyl-alpha-D-galactosamine:polypeptide N-acetylgalactosaminyltransferase 3 (GalNAc-T3) (GALNT3), mRNA [NM_004482] |
| 431 | A_24_P115774 | BIRC2 | GATACGATTTTGGTTAAAGGAAATGCTGCGGCAACATGTTCAAA AACTGTCTAAAAGAA | SEQ ID NO: 2783 | Homo sapiens baculoviral IAP repeat-containing 2 (BIRC2), mRNA [NM_001166] |
| 432 | A_24_P116786 | ZNF207 | TTTGTGAGACAGCAGTATACCAGTGAAATTAGCTTCTGAGTAAAT TTGTAATTTATGCC | SEQ ID NO: 2784 | Homo sapiens mRNA; cDNA DKFZp761N202 (from clone DKFZp761N202), [AL834501] |
| 433 | A_24_P123521 | CLK4 | CCGCACACTGAAAACACAGAGATATCAAGTCGTTGACTTGGAAGT GCAACGTATGATGAT | SEQ ID NO: 2785 | Homo sapiens CDC-like kinase 4 (CLK4), mRNA [NM_020666] |
| 434 | A_24_P124325 | IKZF5 | GCTACAACTTCTTGAACTTCAAGTTAAGGCTAGACATTTACTTTG AAAAATTGCACTGG | SEQ ID NO: 2786 | Homo sapiens mRNA; cDNA DKFZp781B0249 (from clone DKFZp781B0249), [CR749800] |
| 435 | A_24_P124992 | PSMA4 | AAACGTCCTTTGTGTTTCATTGCTGTCGTAGATTGGCTGGGATAAG CACTATGGGTTCAG | SEQ ID NO: 2787 | Homo sapiens proteasome (prosome, macropain) subunit, alpha type, 4 (PSMA4), mRNA [NM_002789] |
| 436 | A_24_P126060 | DDX3X | TGTTGAACGGAGCTTGTCTCTAGGAAGGGGATGGGACTAGATATGTAA AATTTATTTGGGACC | SEQ ID NO: 2788 | Homo sapiens DEAD (Asp-Glu-Ala-Asp) box polypeptide 3, X-linked (DDX3X), mRNA [NM_001356] |
| 437 | A_24_P126741 | ENST00000309178 | AGGCCTCCAACCACACAGTAACAAGATTCAAGATGTTTAGAATAAGTCGTCTGGCTTA CACAGAGGCGAGAAT | SEQ ID NO: 2789 | |
| 438 | A_24_P129232 | SERINC1 | CAAGGTCAGAAGATGATGATGTTTAGAATAAAGTCGTCTGGCTTA TAGTATACTACACAG | SEQ ID NO: 2790 | Homo sapiens serine incorporator 1 (SERINC1), mRNA [NM_020755] |
| 439 | A_24_P132787 | RAB18 | TAAAAACGTCACATTCTACTTGATTTACACGTTCCTAGTCTACATT ACATGTCGTTGAAGG | SEQ ID NO: 2791 | Homo sapiens RAB18, member RAS oncogene family (RAB18), mRNA [NM_021252] |
| 440 | A_24_P133991 | ANKRD12 | TTTGGAATGGAGTATATGCCTGAAAAGGTTTTTGGATTCAGAAGA AAAAGGATGGTTAGT | SEQ ID NO: 2792 | Homo sapiens ankyrin repeat domain 12 (ANKRD12), mRNA [NM_015208] |
| 441 | A_24_P137897 | IFRD1 | AACCAAAGCTAGAAGCAAATGTCGAGATAAGAGAGAGATGTTGG AGAATTCTTCTAGAT | SEQ ID NO: 2793 | Homo sapiens interferon-related developmental regulator 1 (IFRD1), transcript variant 2, mRNA [NM_001007245] |
| 442 | A_24_P139208 | USP25 | CAATATACAGCAAGGTGATTATTTCAAGAGAATCCAAAGTACTT GAATAAGGCTATTG | SEQ ID NO: 2794 | Homo sapiens ubiquitin specific peptidase 25 (USP25), mRNA [NM_013396] |
| 443 | A_24_P146151 | TSNAX | AAAGTTGAGTTATATACTTGTACATAGAATGGAAATGCTTTTAGT AGTGATTATTTAGCA | SEQ ID NO: 2795 | Homo sapiens translin-associated factor X (TSNAX), mRNA [NM_005999] |
| 444 | A_24_P150874 | BX647930 | GTATATTTTGTAATAACCGCGTAGATACTGTACCTAACAAAACAT GACTCGTATTAGGTC | SEQ ID NO: 2796 | Homo sapiens mRNA; cDNA DKFZp686l20201 (from clone DKFZp686l20201), [BX647930] |
| 445 | A_24_P153511 | OSBPL8 | CCTTGTGCATATACAACACAAAAATTTTGTGGAAGGCAGTTTTAAC TTTCTCAAGAATATC | SEQ ID NO: 2797 | Homo sapiens oxysterol binding protein-like 8 (OSBPL8), transcript variant 1, mRNA [NM_020841] |
| 446 | A_24_P157415 | ATP11B | CTGTACTGTAAGCAGCCTGTAAAGTTAGCGATATAAATGAAGG GTATATCATATATC | SEQ ID NO: 2798 | Homo sapiens ATPase, Class VI, type 11B (ATP11B), mRNA [NM_014616] |

Fig. 7-25

| No. | Probe ID No. | Symbols of genes | Sequence | SEQ ID NO: | Descriptions of genes (letters and numbers within [ ] indicates GenBank accession No.) |
|---|---|---|---|---|---|
| 447 | A_24_P165816 | AK023645 | AAGATTGAATGGCTAGGAGTAATTCTGTTCTGGTATAGGGAACTTAACTTCACTGTGGAA | SEQ ID NO: 2799 | Homo sapiens cDNA FLJ13583 fis, clone PLACE1008050. [AK023645] |
| 448 | A_24_P166094 | ARFIP1 | TCATTCCTTCCTGTATATTTGTACTCAGAGAGCCTTATTTTATTCTTCCAGGAGAATTAC | SEQ ID NO: 2800 | Homo sapiens ADP-ribosylation factor interacting protein 1 (arfaptin 1) (ARFIP1), transcript variant 1, mRNA [NM_001025595] |
| 449 | A_24_P166794 | BC047111 | AGCTTACAGTGTTCAGGTTGTGATTATTTCAAAATGGAGTGACTGTGAACATCACT | SEQ ID NO: 2801 | Homo sapiens cDNA clone IMAGE:5314178. [BC047111] |
| 450 | A_24_P167063 | ZNF518 | AAAGAAAGCCATACATAGAATGCTTCAAGGTATCTTGGCTATGCACATTATAGTTGTACTG | SEQ ID NO: 2802 | Homo sapiens zinc finger protein 518 (ZNF518), mRNA [NM_014803] |
| 451 | A_24_P172481 | TRIM22 | TGCCCCTTAAAGATTGAAGAGAAGAAAGTTCAACTCATATCCACGTTATCTAGCAA | SEQ ID NO: 2803 | Homo sapiens tripartite motif-containing 22 (TRIM22), mRNA [NM_006074] |
| 452 | A_24_P175059 | ATG5 | TTGACAAGAGGGCTGGTCTGAATGATTGTTCACATTAAGAGTGTTTATTCGTCGGTTC | SEQ ID NO: 2804 | Homo sapiens ATG5 autophagy related 5 homolog (S. cerevisiae) (ATG5), mRNA [NM_004849] |
| 453 | A_24_P175176 | PHTF2 | AGATTGAGGTTAACTTAGAGTTGGGAGTTGATTTATTAAGTAGAGTATACGTCTCAACAG | SEQ ID NO: 2805 | Homo sapiens putative homeodomain transcription factor 2 (PHTF2), mRNA [NM_020432] |
| 454 | A_24_P175187 | SAMD9 | CAACCAGGGATACGTAATCAAACAGTAATCAAAATGTAATTTTCCGCTAATAAAATTATGGAATGGAAGCAG | SEQ ID NO: 2806 | Homo sapiens sterile alpha motif domain containing 9 (SAMD9), mRNA [NM_017654] |
| 455 | A_24_P175188 | SAMD9 | TGCCAATGTACTGGCACATTCTCTTTAGTTACAACAACCTATGTTTTTGAACAAAAACAACCAGGGATA | SEQ ID NO: 2807 | Homo sapiens sterile alpha motif domain containing 9 (SAMD9), mRNA [NM_017654] |
| 456 | A_24_P180424 | TMEM30A | CAATGTGTATGGACAATTCTCTTTAGTTACAAGAAGGTAGTAGCAGTTGGTTTCCTAAG | SEQ ID NO: 2808 | Homo sapiens transmembrane protein 30A (TMEM30A), mRNA [NM_018247] |
| 457 | A_24_P18105 | ASPH | GCTCTGTTGAAAATAACCTTGTCAGAAAAGAAGGTAGTAGCAGCATGATTTTGAAAGG | SEQ ID NO: 2809 | Homo sapiens aspartate beta-hydroxylase (ASPH), transcript variant 3, mRNA [NM_032466] |
| 458 | A_24_P183864 | IMPA1 | TCAGCTTATCCCTTGGCACGTAAACAGACTACTATTGTAGGTTCGTTTGAGCT | SEQ ID NO: 2810 | Homo sapiens inositol(myo)-1(or 4)-monophosphatase 1 (IMPA1), mRNA [NM_005536] |
| 459 | A_24_P190804 | AP1S2 | GGTGGAAGATCTAAGGAGTCTTCATGTACTTCATTAAAAATAACATGGATTCCAATACTG | SEQ ID NO: 2811 | Homo sapiens adaptor-related protein complex 1, sigma 2 subunit (AP1S2), mRNA [NM_003916] |
| 460 | A_24_P191417 | NAB1 | AAGTTTCCTTAACTATCTATGTTTCTAGTCTTTCAAGCTTAGTGATAAGGTGGAAGCAC | SEQ ID NO: 2812 | Homo sapiens NGFI-A binding protein 1 (EGR1 binding protein 1) (NAB1), mRNA [NM_005966] |
| 461 | A_24_P196351 | PLXNC1 | ACCTCAAAGAAGAAAATACGAAAACTAGATGACAGATGAGAATAAAGGTGAGAGGTCTGG | SEQ ID NO: 2813 | Homo sapiens mRNA for plexin C1 variant protein. [AB208934] |
| 462 | A_24_P20120 | KIAA1212 | TTGGACAATGAAAATGGCTAAAAGGAATGCATATGGATAAAGTTGCACTTATAACAGCC | SEQ ID NO: 2814 | Homo sapiens KIAA1212 (KIAA1212), mRNA [NM_018084] |
| 463 | A_24_P201702 | CLEC2B | ATTGGAATTCAAGTAAATAAATAGAATTTAGTAAATATTCCAGCCGGTCGTTTTAGTATAATTGACA | SEQ ID NO: 2815 | Homo sapiens C-type lectin domain family 2, member B (CLEC2B), mRNA [NM_005127] |
| 464 | A_24_P208045 | EDEM3 | TTTAGAGGGGGTAGAATTTAGTAAATATTCCAGCGGGTCGTTTTATGACAAGGCTTCA | SEQ ID NO: 2816 | Homo sapiens ER degradation enhancer, mannosidase alpha-like 3 (EDEM3), mRNA [NM_025191] |
| 465 | A_24_P208567 | IL18R1 | GGGAGGCTTCTTGATGATCTCAAAAATAATAGCTATTCAAGAAAATCACCAAGTGACTGT | SEQ ID NO: 2817 | Homo sapiens interleukin 18 receptor 1 (IL18R1), mRNA [NM_003855] |
| 466 | A_24_P20996 | BC043173 | CTGAAAATGTTCATATATGTATATGAATGTCTTTATGCTGAAGGGCTCGATTGG | SEQ ID NO: 2818 | Homo sapiens cDNA clone IMAGE:5287121. [BC043173] |

Fig. 7-26

| No. | Probe ID No. | Symbols of genes | Sequence | SEQ ID NO: | Descriptions of genes (letters and numbers within [ ] indicates GenBank accession No.) |
|---|---|---|---|---|---|
| 467 | A_24_P216654 | SOAT1 | CGCAGTAATGTTCTGGCACAAACAGTATTGTAATTGTAATGGAATCATAAGCTGCTAACTAG | SEQ ID NO: 2819 | Homo sapiens sterol O-acyltransferase (acyl-Coenzyme A: cholesterol acyltransferase) 1 (SOAT1), transcript variant 688113, mRNA [NM_003101] |
| 468 | A_24_P223124 | FNDC3B | CTCACTGTTGGACATACATCCAAGCTTTCAACTGTAGGAGAAAAAGAAAATCATGTTT | SEQ ID NO: 2820 | Homo sapiens fibronectin type III domain containing 3B (FNDC3B), mRNA [NM_022763] |
| 469 | A_24_P225308 | ARID4B | GTTGAAAATGGTTTCCAAGTTATTCAAATTGTACAGGACTGTAAAGATTGTTGACAGGA | SEQ ID NO: 2821 | Homo sapiens AT rich interactive domain 4B (RBP1-like) (ARID4B), transcript variant 1, mRNA [NM_016374] |
| 470 | A_24_P225719 | PREI3 | GACTATTTCTTAGTGAATATTGAATATTTATAGTAAGGTAGTCACTGAGATTTGGTGATCTGGCTG | SEQ ID NO: 2822 | Homo sapiens preimplantation protein 3 (PREI3), transcript variant 1, mRNA [NM_015387] |
| 471 | A_24_P235429 | ABCA1 | CCAAGAGCCATGTGTCATGTAATACTGAACCACTTTGATATTGAGACATTAATTTGTAC | SEQ ID NO: 2823 | Homo sapiens ATP-binding cassette, sub-family A (ABC1), member 1 (ABCA1), mRNA [NM_005502] |
| 472 | A_24_P235988 | CLEC7A | TTTTTTCCAGTAATTACCTGTAAAATGGTATTATTGGAATAGAAACTATATTCCTCATGT | SEQ ID NO: 2824 | Homo sapiens C-type lectin domain family 7, member A (CLEC7A), transcript variant 1, mRNA [NM_197947] |
| 473 | A_24_P238008 | SCYL2 | ATAGACTATGTAGTTGTCTGTGGTTTTGTTTTATTTGGAATGCTTATAAAGCCTCC | SEQ ID NO: 2825 | Homo sapiens mRNA for KIAA1360 protein, partial cds. [AB037781] |
| 474 | A_24_P236799 | RAB31 | ATTAAAGAGCTCGAACTGTATTCAGACGCAGTTGGTATCGTAGCTTACTGTTTTAAGATC | SEQ ID NO: 2826 | Homo sapiens RAB31, member RAS oncogene family (RAB31), mRNA [NM_006868] |
| 475 | A_24_P242299 | ZRANB2 | GACTTTTTGAAAGTCTACCTTCTAAATTGCCGCGACGATGTAGATTCTACATGTTACGAT | SEQ ID NO: 2827 | Homo sapiens zinc finger, RAN-binding domain containing 2 (ZRANB2), transcript variant 2, mRNA [NM_005455] |
| 476 | A_24_P248606 | ACSL3 | GTATTTGATGATGAATAGCATTCTCACTAAGACACATGAGAATTTAACTTTAATAACCCGGCTGAG | SEQ ID NO: 2828 | Homo sapiens acyl-CoA synthetase long-chain family member 3 (ACSL3), transcript variant 1, mRNA [NM_004457] |
| 477 | A_24_P250922 | PTGS2 | TGAGATATTTAAGGTTGAATGTTGTCCTTAGGATAGGGCCTATGTGCTAGCCCACAAAGA | SEQ ID NO: 2829 | Homo sapiens prostaglandin-endoperoxide synthase 2 (prostaglandin G/H synthase and cyclooxygenase) (PTGS2), mRNA [NM_000963] |
| 478 | A_24_P251221 | PPP2R5A | TGAATTCTTCTTTGAATTGTGTTGGACATAGATATGGTAGTCTGCTCTGTATATTTTCCC | SEQ ID NO: 2830 | Homo sapiens protein phosphatase 2, regulatory subunit B', alpha isoform (PPP2R5A), mRNA [NM_006243] |
| 479 | A_24_P25326 | ZMYM6 | AGCACTATTTAAATACAGTGTCTGTAACTCAGTTTTGGATAAATGCAAAGACAAGTTACCC | SEQ ID NO: 2831 | Homo sapiens zinc finger, MYM-type 6 (ZMYM6), mRNA [NM_007167] |
| 480 | A_24_P257151 | CLK1 | TATGCAAAGTCTGTGAATTTTTGGACAGTAATAAGTTGACTGACACAGACTAAAGCCTG | SEQ ID NO: 2832 | Homo sapiens CDC-like kinase 1 (CLK1), transcript variant 1, mRNA [NM_004071] |
| 481 | A_24_P263144 | BMX | CAGCTCCAGAGGTGTTTCATTACTTCAAATACAGCAGCAAGTCAGACGTATGGGCATTTG | SEQ ID NO: 2833 | Homo sapiens BMX non-receptor tyrosine kinase (BMX), mRNA [NM_001721] |
| 482 | A_24_P263524 | TXNDC9 | TGACTTCACCACAGAAAGCTTAGAAATGGGAGGCTCAGTGTTCTGACATTCTTAATTACAG | SEQ ID NO: 2834 | Homo sapiens thioredoxin domain containing 9 (TXNDC9), mRNA [NM_005783] |
| 483 | A_24_P265856 | SENP7 | TTGTGTGTGTTGGGGGGTAGTTTTAAAGGTGACTATTGTTAGATGTAATTTTGGGA | SEQ ID NO: 2835 | Homo sapiens SUMO1/sentrin specific peptidase 7 (SENP7), transcript variant 1, mRNA [NM_020654] |

Fig. 7-27

| No. | Probe ID No. | Symbols of genes | Sequence | SEQ ID NO: | Descriptions of genes (letters and numbers within [ ] indicates GenBank accession No.) |
|---|---|---|---|---|---|
| 484 | A_24_P268786 | MYNN | TGCAGAGGATCATACATTTGAGTGAACAGGATTCCATACAAAAAAG TCCTTTATCAGAAAC | SEQ ID NO: 2836 | Homo sapiens myoneurin (MYNN), mRNA [NM_018657] |
| 485 | A_24_P269917 | RAB33B | CCCAGAATCTAATGTAGTTCGCTATTAATAAGAATGCATTATTGA AAGTATATTGCAAAT | SEQ ID NO: 2837 | Homo sapiens RAB33B, member RAS oncogene family (RAB33B), mRNA [NM_031296] |
| 486 | A_24_P274615 | ARRDC3 | AGCAAAACAAAGTGCAATATTAAATGTTTGGTTTATAGATATTAT TCTATGGGTGTTTGT | SEQ ID NO: 2838 | Homo sapiens arrestin domain containing 3 (ARRDC3), mRNA [NM_020801] |
| 487 | A_24_P278583 | TMCO1 | CCTTCATTTTCCTGTATATTCTCGTACTATGTCGATTCGACAGA ACATTCAGAAGATTC | SEQ ID NO: 2839 | Homo sapiens transmembrane and coiled-coil domains 1 (TMCO1), mRNA [NM_019026] |
| 488 | A_24_P278460 | MLSTD2 | AGCCATGGAAACAATATGCTTAGGATTAGAGGAAGCAGTCCTTACT TACACTTCTTGTCTG | SEQ ID NO: 2840 | Homo sapiens male sterility domain containing 2 (MLSTD2), mRNA [NM_032228] |
| 489 | A_24_P285501 | ZNF650 | CATGGTATAATGTATTCAGACTTTGATTACTACTTATTTAAAATG GAATGTTTTATGGTT | SEQ ID NO: 2841 | Homo sapiens zinc finger protein 650 (ZNF650), mRNA [NM_170707] |
| 490 | A_24_P286054 | ZFYVE16 | GTGTATGTATTCTGCCATGTAAGTAATTGAACAGTCTTAAAATAA CCAAATGGTAGAGGG | SEQ ID NO: 2842 | Zinc finger FYVE domain-containing protein 16 (Endofin) (Endosome-associated FYVE domain protein). [Source:Uniprot/SWISSPROT:Acc:Q7Z3T8] [ENST00000380248] |
| 491 | A_24_P28657 | AHCTF1 | AACAGACGGCCTGTTGTCTACAGAGTACAACTGTGTGGAATTAAGCA ATGGTACTTGATGTA | SEQ ID NO: 2843 | Homo sapiens AT hook containing transcription factor 1 (AHCTF1), mRNA [NM_015446] |
| 492 | A_24_P287756 | NUDT21 | CCCATACTTACTTCACTTGTTATACATCACTGATTATTTGCGTTA AACTGGAGTCATTTC | SEQ ID NO: 2844 | Homo sapiens nudix (nucleoside diphosphate linked moiety X)-type motif 21 (NUDT21), mRNA [NM_007006] |
| 493 | A_24_P290257 | A_24_P290257 | CGAATTCATTCAACGATAGAACAAGCCAATTATACCATCGAGTCAT TGAAGGACAGCAAGA | SEQ ID NO: 2845 | |
| 494 | A_24_P29277 | COL4A3BP | TTAAAGTACCTTGGGAGTGTGTAGAGTAAGTCTCTATAATAGCTTT ATGATCCTGATGATG | SEQ ID NO: 2846 | Goodpasture antigen-binding protein (EC 2.7.11.9) (GPBP) (Collagen type IV alpha-3-binding protein) (StAR-related lipid transfer protein 11) (StARD11) (START domain-containing protein 11). [Source:Uniprot/SWISSPROT:Acc:Q9Y5P4] [ENST00000380494] |
| 495 | A_24_P295543 | BLOC1S2 | GTTTATTTCTATGTGAGTCACATTGACATGCGATCAGTTTGGGA AATGTGATGAAAACA | SEQ ID NO: 2847 | Homo sapiens biogenesis of lysosome-related organelles complex-1, subunit 2 (BLOC1S2), transcript variant 2, mRNA [NM_001001342] |
| 496 | A_24_P2995 | PUM2 | TTTTTGAATAGGCTACTCCCAAGTAAGAGCAAATCTGTATGATAA CATTTTTGCTGTGG | SEQ ID NO: 2848 | Homo sapiens pumilio homolog 2 (Drosophila) (PUM2), mRNA [NM_015317] |
| 497 | A_24_P30194 | IFIT5 | AATGTGGCTTGTCTAATGTAGTTCTTTGATTACCGACTACAACGA TTATGACCATCACA | SEQ ID NO: 2849 | Homo sapiens interferon-induced protein with tetratricopeptide repeats 5 (IFIT5), mRNA [NM_012420] |
| 498 | A_24_P303454 | TIAM2 | GCGAGAATTCAGTGTCCAGAGATTTAACATCGTTGTCAGTGAGGA GTGTTTTTATGAAAC | SEQ ID NO: 2850 | Homo sapiens T-cell lymphoma invasion and metastasis 2 (TIAM2), transcript variant 1, mRNA [NM_012454] |
| 499 | A_24_P303647 | FLJ31818 | ACTGTATGGGTACTCCTAAGAATTATTTCATTTTGGATATAAAGA AGTTATGAGGCCTCG | SEQ ID NO: 2851 | Homo sapiens hypothetical protein FLJ31818 (FLJ31818), mRNA [NM_152556] |

Fig. 7-28

| No. | Probe ID No. | Symbols of genes | Sequence | SEQ ID NO: | Descriptions of genes (letters and numbers within [ ] indicates GenBank accession No.) |
|---|---|---|---|---|---|
| 500 | A_24_P303852 | GNAQ | GCTTTTGGTAGACAGAAAAACAGAAAAGGTATTCGTTGGTAGAACATTTTTAAGTTCAGG | SEQ ID NO: 2852 | Guanine nucleotide-binding protein G(q) subunit alpha (Guanine nucleotide-binding protein alpha-q) [Source:Uniprot/SWISSPROT:Acc:P50148] [ENST00000376611] |
| 501 | A_24_P307395 | A_24_P307395 | CTCGTCTGTTTATGTGGACATGATTCAACTCCAACTTAAATTGCAGGGGTGTGTTCCAT | SEQ ID NO: 2853 | |
| 502 | A_24_P310894 | CAPZA1 | TGTATTATTGTCGTTCATACTATCCATCCATACCACACTGTTCTGTATCAGGTAGTC | SEQ ID NO: 2854 | Homo sapiens capping protein (actin filament) muscle Z-line, alpha 1 (CAPZA1), mRNA [NM_006135] |
| 503 | A_24_P312417 | ZBTB26 | AGAGGAGGAAGATTTTTAAAAACCTTTATCATTCAGGATTTGTATTTATGGATCCCAGG | SEQ ID NO: 2855 | Zinc finger and BTB domain-containing protein 26 (Zinc finger protein 481) (Zinc finger protein Bioref). [Source:Uniprot/SWISSPROT:Acc:Q9HCK0] [ENST00000373856] |
| 504 | A_24_P317604 | SLC37A3 | CCCGGTGTTGTTTGGCCTATTGAGGTTTAGGGTTTTTAACCTTAAGTGTTGTTTGGAC | SEQ ID NO: 2856 | Homo sapiens solute carrier family 37 (glycerol-3-phosphate transporter), member 3 (SLC37A3), transcript variant 1, mRNA [NM_207113] |
| 505 | A_24_P320328 | SUB1 | CAGAAAAACGTGTAAAGAAACAGAAAAGACAGGTGAGACTCGAGAGCCCTGTCTGTCTGTA | SEQ ID NO: 2857 | Homo sapiens SUB1 homolog (S. cerevisiae) (SUB1), mRNA [NM_006713] |
| 506 | A_24_P322353 | PSTPIP2 | AGAATCTTTCGCTTGCTAGACCCAGAATTTTTAAATGCATCCGTCTTACACTTTCAGAAA | SEQ ID NO: 2858 | Homo sapiens proline-serine-threonine phosphatase interacting protein 2 (PSTPIP2), mRNA [NM_024430] |
| 507 | A_24_P324506 | A_24_P324506 | GCAATATAAGGAGGTAATTGCAAATACAAGTATGGCTATTTCGTGTGGACATGCTGTGT | SEQ ID NO: 2859 | |
| 508 | A_24_P324577 | KIAA1466 | AAGAATTTAAGTAGGCGGCCCTGAAGTTAGGAGTTAAAGAAGGATATTAACTGCCAGTCGCA | SEQ ID NO: 2860 | Homo sapiens mRNA for KIAA1466 protein, partial cds. [AB040899] |
| 509 | A_24_P324551 | KIAA1466 | ATAATAGCTCATAGAATGAATTGCTGTACCAACCAAGGCTAAAAGAATTTAAGTAGCGG | SEQ ID NO: 2861 | Homo sapiens mRNA for KIAA1466 protein, partial cds. [AB040899] |
| 510 | A_24_P324886 | DOCK4 | ATTTTCGCTTTCGTTTGTTGGGAAGCTCATTTTAGTTTAACCATGTTGTTTTGTTGGTAGG | SEQ ID NO: 2862 | Homo sapiens dedicator of cytokinesis 4 (DOCK4), mRNA [NM_014705] |
| 511 | A_24_P325176 | KIAA1109 | TTGATCCAGTAGGTGTTGATTATATTCTTGAAAAATTGGGCTTTGATCATGCTAGGACTA | SEQ ID NO: 2863 | Homo sapiens KIAA1109, mRNA (cDNA clone IMAGE:3924668), complete cds. [BC108274] |
| 512 | A_24_P330397 | STRN3 | ATGGTGTAACTAACTAAAGATTTGTTTGTGTAATGCATGATTAAGACAATAAAGTATTTTTC | SEQ ID NO: 2864 | Homo sapiens striatin, calmodulin binding protein 3 (STRN3), mRNA [NM_014574] |
| 513 | A_24_P33213 | A_24_P33213 | GACCATATATTACATGGGGATACCGAAATCTGAAGTCACTAAATGAACTTATCTACAAGG | SEQ ID NO: 2865 | |
| 514 | A_24_P333112 | A_24_P333112 | GGTCATCAGAATCAGAGTATCAATGTGTGAGCCCAGAGGACCAAAAGGTATTGCAACTT | SEQ ID NO: 2866 | |
| 515 | A_24_P336728 | LPGAT1 | AGAGCAAAAGTTTTTAAGTGTATTCAGTTGGCAAAGTATGCACACATATCTTGAATGGC | SEQ ID NO: 2867 | Homo sapiens lysophosphatidylglycerol acyltransferase 1 (LPGAT1), mRNA [NM_014873] |
| 516 | A_24_P351906 | STEAP4 | ATATCCCGTTGATTTGACTTGCATTGTGGAATAAGCAAAGAAGGGTTGATAAAGTTCT | SEQ ID NO: 2868 | Homo sapiens STEAP family member 4 (STEAP4), mRNA [NM_024636] |
| 517 | A_24_P354412 | AK091335 | TGTAGACTGAAGGAGTCTTCAAAACACGCCAGCAATAAATCTCACTCTGGGGTGCTTCT | SEQ ID NO: 2869 | Homo sapiens cDNA FLJ34016 fis, clone FCBBF2002541. [AK091335] |
| 518 | A_24_P354954 | CCDC126 | AATGGAACTCTTTGAGGACTTTAGGCAGGTGTATATAATAAAGGTACTTTTGTGCTGCATT | SEQ ID NO: 2870 | Homo sapiens coiled-coil domain containing 126 (CCDC126), mRNA [NM_138771] |

Fig. 7-29

| No. | Probe ID No. | Symbols of genes | Sequence | SEQ ID NO: | Descriptions of genes (letters and numbers w/hile [ ] indicates GenBank accession No.) |
|---|---|---|---|---|---|
| 519 | A_24_P355816 | DRAM | ATAATATAGAATGGGATTACTGCTGGTTTACCAGTTAGTTTGATAATAAACAAATAGTCT | SEQ ID NO: 2871 | Homo sapiens damage-regulated autophagy modulator (DRAM), mRNA [NM_018370] |
| 520 | A_24_P357576 | KIAA1370 | TGCTGCATATGAAGCTCAAATCTTACACTGAATCACCAACAAACCCTCAGTTTCACGAAG | SEQ ID NO: 2872 | Homo sapiens KIAA1370 (KIAA1370), mRNA [NM_019600] |
| 521 | A_24_P362646 | TXNDC9 | CTCGAGATTCAGGTGTAAAATACTAGAGAGACATCGGAATATTGTCAAGAAACACGT | SEQ ID NO: 2873 | Homo sapiens thioredoxin domain containing 9 (TXNDC9), mRNA [NM_005783] |
| 522 | A_24_P364025 | UBE2D1 | ATGTGATGGGTGTAGTCATTAGCAAAGCATTAAATACTCAGTATTTTGTCATGGTTC | SEQ ID NO: 2874 | Homo sapiens ubiquitin-conjugating enzyme E2D 1 (UBC4/5 homolog, yeast) (UBE2D1), mRNA [NM_003338] |
| 523 | A_24_P364066 | BC030112 | AATGTCTATTACGGTTTGGGATAGTATTTCTGTCTAGTTCTCAGTGATTTAAATGTGAGG | SEQ ID NO: 2875 | Homo sapiens cDNA clone IMAGE:4799578. [BC030112] |
| 524 | A_24_P364807 | AYTL1 | TGTAACTGTTGTTCTAGGTAATCGTTCTCTCTCAAGAAACTCTGAAGCGTCTGTGTAA | SEQ ID NO: 2876 | Homo sapiens mRNA; cDNA DKFZp686H22112 (from clone DKFZp686H22112). [BX641069] |
| 525 | A_24_P370096 | ZNF230 | GAAACCTTATATTGTGAGAAATGTGGAGGGCCTTCATTCAAGATTTAAAGGTCAGAA | SEQ ID NO: 2877 | Homo sapiens zinc finger protein 230 (ZNF230), mRNA [NM_006301] |
| 526 | A_24_P370172 | LILRA5 | AGCCACAGGTGGATGCTCAGATGCTATATGGCTCTCGCAGGCATATCCTGCAGGTATGGTCA | SEQ ID NO: 2878 | Homo sapiens leukocyte immunoglobulin-like receptor, subfamily A (with TM domain), member 5 (LILRA5), transcript variant 3, mRNA [NM_181879] |
| 527 | A_24_P371053 | ORMDL1 | GAATGAAAAGAGTTACAGACCAACTTAAACATCAATTCGTCTGTCAGTAAACTGACTTTTGG | SEQ ID NO: 2879 | Homo sapiens ORM1-like 1 (S. cerevisiae) (ORMDL1), mRNA [NM_016467] |
| 528 | A_24_P372625 | RNF141 | CTATGTACTGAACTTTAGAGGGTTGAGATGTGAGAATAATAATCATCTGTGTTATTCTTAGTACCCACTG | SEQ ID NO: 2880 | Homo sapiens ring finger protein 141 (RNF141), mRNA [NM_016422] |
| 529 | A_24_P374319 | RAP2C | AATTGTGTGATGTTCAAATAAAGTCGTATCATCACATTCATGTGATTTATGGTCAGCATG | SEQ ID NO: 2881 | Homo sapiens RAP2C, member of RAS oncogene family (RAP2C), mRNA [NM_021183] |
| 530 | A_24_P379379 | CAPZA1 | ACCAGTTCAGCGTAAAAAGTTCGGAATGGTCGTTGGAGATAGAGTGGAAGTTCACCA | SEQ ID NO: 2882 | Homo sapiens capping protein (actin filament) muscle Z-line, alpha 1 (CAPZA1), mRNA [NM_006135] |
| 531 | A_24_P380679 | FLJ38575 | GAACCTGCATTAGTTCCAGGAATGAAAGTAAGACAGAGAGATATGACATAAGAACAGT | SEQ ID NO: 2883 | Homo sapiens hypothetical protein FLJ39575 (FLJ39575), mRNA [NM_182597] |
| 532 | A_24_P381625 | PSMC6 | ATGAAAGGAGTCAGAAAAGTGGCTGATCTAAGAAGCTGGAGGTCTAAAATTGGACTAGAA | SEQ ID NO: 2884 | Homo sapiens proteasome (prosome, macropain) 26S subunit, ATPase, 6 (PSMC6), mRNA [NM_002806] |
| 533 | A_24_P387869 | PKN2 | TTGTCGAGATGATCATTTATATTAGCTTCCAAATTGTTTGTCAGAATTAAGATGCTTTGGGAG | SEQ ID NO: 2885 | Homo sapiens protein kinase N2 (PKN2), mRNA [NM_006256] |
| 534 | A_24_P39378 | CCPG1 | TACTTTTTGTGGCTGGAACGAAGTTGATCAGTTCATGAATAAGTTTTTCCTAAACGGTGT | SEQ ID NO: 2886 | Homo sapiens cell cycle progression 1 (CCPG1), transcript variant 1, mRNA [NM_004748] |
| 535 | A_24_P393811 | TMCO1 | AGATGACACGACAGACAGAGACTGTTCGTTCATTTCTGTATATTCCTCTGTACTATGCGATTCG | SEQ ID NO: 2887 | Homo sapiens transmembrane and coiled-coil domains 1 (TMCO1), mRNA [NM_019026] |
| 536 | A_24_P396231 | BC040653 | GGATGTATCGATTTAGAGAAACCAATTAATACCTGCAAAATAAAGCATAGGTGGTAGTTG | SEQ ID NO: 2888 | Homo sapiens cDNA clone IMAGE:4797120. [BC040653] |
| 537 | A_24_P396702 | CD302 | GGATTCTTGTAGTGAGGAGTGTATGGTCTCTTTTGTTCAGAATTAAAACTGATAACCAA | SEQ ID NO: 2889 | Homo sapiens CD302 molecule (CD302), mRNA [NM_014880] |
| 538 | A_24_P398940 | CASC4 | CACTTGGTTGGTTGTATTGTAGGTATTAGTATACAGGAACATTCTTCAATTAGGAGTC | SEQ ID NO: 2890 | Homo sapiens cancer susceptibility candidate 4 (CASC4), transcript variant 1, mRNA [NM_138423] |

Fig. 7-30

| No. | Probe ID No. | Symbols of genes | Sequence | SEQ ID NO: | Descriptions of genes (letters and numbers within [ ] indicate GenBank accession No.) |
|---|---|---|---|---|---|
| 539 | A_24_P399942 | ATP11C | TGAGGATGTTACCTACTACTAAACTGAAAACATTCATTCCATATCTACTTAACATACACCAG | SEQ ID NO: 2891 | Homo sapiens ATPase, Class VI, type 11C (ATP11C), transcript variant 1, mRNA [NM_173694] |
| 540 | A_24_P40417 | FMR1 | TTGTGAGTTTGTTCTTTGAATTTTGAATTTTTACAGTTACTTTGCTTGCATACAAACAAG | SEQ ID NO: 2892 | Homo sapiens fragile X mental retardation 1 (FMR1), mRNA [NM_002024] |
| 541 | A_24_P405298 | PPP1CB | GTATTAGGTTAGGTCAGAAAGGTTTATCTGAGGTGATTAAATAACTTCCTGATTGGAG | SEQ ID NO: 2893 | Homo sapiens protein phosphatase 1, catalytic subunit, beta isoform (PPP1CB), transcript variant 1, mRNA [NM_002709] |
| 542 | A_24_P405430 | TIA1 | GGATTTTCTCTGTTGTTAAATCACAAAAATGATAGTCCCAATCGTTTCTTTATAGGAGG | SEQ ID NO: 2894 | Homo sapiens cDNA FLJ36425 fis, clone THYMU2011482. [AK093744] |
| 543 | A_24_P406034 | SLC35A1 | ATGTACAGTATTTTGTCCTAGCAGCATAAAGACCTAGCTCTTTTCTTACAAGAGGCAGAA | SEQ ID NO: 2895 | Homo sapiens solute carrier family 35 (CMP-sialic acid transporter), member A1 (SLC35A1), mRNA [NM_006416] |
| 544 | A_24_P406060 | IBRDC2 | CTTATCCAGGTTGCAAATGTACATGTTCATTTGAATGTAAATCACCATTCTCTGGAACC | SEQ ID NO: 2896 | Homo sapiens IBR domain containing 2 (IBRDC2), mRNA [NM_182757] |
| 545 | A_24_P407311 | ERO1L | TAACATGTTGAAATGTCACATTAGTAGTAAAGTGGGGTTTATTATATAATGGTTAAGAA | SEQ ID NO: 2897 | Homo sapiens ERO1-like (S. cerevisiae) (ERO1L), mRNA [NM_014584] |
| 546 | A_24_P413699 | PFKFB2 | TCAAATGGTTCTTTTATACTCTGGATGATACAGGACTCTGTTACCTAAGATGTGATAAGC | SEQ ID NO: 2898 | Homo sapiens 6-phosphofructo-2-kinase/fructose-2,6-biphosphatase 2 (PFKFB2), transcript variant 2, mRNA [NM_001018053] |
| 547 | A_24_P414556 | TTC33 | TACTCAAGATTGTATATTTGTTTTGAGTAATGATGTTTGTTTTTGTGTAATTTTGTGA | SEQ ID NO: 2899 | Homo sapiens tetratricopeptide repeat domain 33 (TTC33), mRNA [NM_012382] |
| 548 | A_24_P417281 | TXNDC10 | ATGATGAGTGATTCTTGGGAAGAATAAATGTTAATGTTCCGAATAGTCAAGCTTGTTTGC | SEQ ID NO: 2900 | Homo sapiens thioredoxin domain containing 10 (TXNDC10), mRNA [NM_019022] |
| 549 | A_24_P419211 | MTMR6 | AGAAACAAAACATAAAAACCCGAAAACTAAATCGACTTGGAATTAGCAATATCACCCAAGTGG | SEQ ID NO: 2901 | Homo sapiens myotubularin related protein 6 (MTMR6), mRNA [NM_004685] |
| 550 | A_24_P450172 | AK095151 | ATGCACTGAATAAAGCTACTTAAACCAGAGTAATTTTGGGATATTAATCCTAGGGCTAC | SEQ ID NO: 2902 | Homo sapiens cDNA FLJ37832 fis, clone BRSSN2009630. [AK095151] |
| 551 | A_24_P45620 | UTS2 | AGAAAGTTCAGGATTTCTCTGGACAAGAATGGCTAACATTTTACTGAGTCATCTTTTGGCG | SEQ ID NO: 2903 | Homo sapiens urotensin 2 (UTS2), transcript variant 1, mRNA [NM_021995] |
| 552 | A_24_P487736 | CXorf23 | TGCATACCTACTATGTCGTAAGAGACAAATGGAATGGAATTTTTAAATGAAATTTTTAAGGCCC | SEQ ID NO: 2904 | Homo sapiens chromosome X open reading frame 23 (CXorf23), mRNA [NM_198279] |
| 553 | A_24_P514678 | DB728175 | ATCAACAGTGTGTCAATTAAGGAATTGCTCATATTCTCGTGAATAAAGAGCAAAGTCG | SEQ ID NO: 2905 | DB728175 RIKEN full-length enriched human cDNA library, hypothalamus Homo sapiens cDNA clone HQ33001B22 3', mRNA sequence [DB728175] |
| 554 | A_24_P532232 | CREB5 | TCGTGAACACATTTATTGTTACCAATGGAGAATGAGTCATTAAGACTGTTGTTCAACTAGGT | SEQ ID NO: 2906 | Homo sapiens cAMP responsive element binding protein 5 (CREB5), transcript variant 1, mRNA [NM_182898] |
| 555 | A_24_P538403 | ROCK1 | TTAGAGGTTTGTTGGACTTTCATAAATTGAGTACAGATCTCTTTGGATCAAACTACCTGCTAC | SEQ ID NO: 2907 | Homo sapiens Rho-associated, coiled-coil containing protein kinase 1 (ROCK1), mRNA [NM_005406] |
| 556 | A_24_P54178 | TMED5 | GCTCTGATAATGCATTTGGATGATTAATGTTATGCTGTTGTTCATGTGAATGTCAAGACA | SEQ ID NO: 2908 | Homo sapiens transmembrane emp24 protein transport domain containing 5 (TMED5), mRNA [NM_016040] |

Fig. 7-31

| No. | Probe ID No. | Symbols of genes | Sequence | SEQ ID NO: | Descriptions of genes (letters and numbers within [ ] indicate GenBank accession No.) |
|---|---|---|---|---|---|
| 557 | A_24_P551028 | LOC339745 | TCCAGTTGAAGAAATATTGAGTGCCTATGATATGGAAGACTAACT CCTTACTACGGAATGA | SEQ ID NO: 2909 | Homo sapiens hypothetical protein LOC339745 (LOC339745), mRNA [NM_001001684] |
| 558 | A_24_P56240 | CPNE8 | TACAACTATGTGACTTAGTGCACAACACATTGTGAAATAACCTA GTCCTATATACTGAC | SEQ ID NO: 2910 | Homo sapiens copine VIII (CPNE8), mRNA [NM_153634] |
| 559 | A_24_P56252 | AF086032 | GTATCTAAAGTGAACAGCTGTGCTATATTGATTTTATTGGT AGTATTGAGCAGAGC | SEQ ID NO: 2911 | Homo sapiens full length insert cDNA clone YW25609. [AF086032] |
| 560 | A_24_P592591 | A_24_P592591 | GAATTTGTTACACGTGGAGGAAGGGAGACGTTGAGGAATATGGT CAGGATGTTCCAT | SEQ ID NO: 2912 | |
| 561 | A_24_P592591 | THC2815064 | CAGTGGTGTAACTCATCAATACATGGTGTCATTTTATTCTCTATATTTC AGGTAAGTGAAAGGG | SEQ ID NO: 2913 | BX491310 DKFZp686K2197_r1 686 (synonym: hlcc3) Homo sapiens cDNA clone DKFZp686K2197 5', mRNA sequence [BX491310] |
| 562 | A_24_P62860 | STAM2 | GTCTATATGGTAGTTGATCTAGATTTAAGTGGAAAAATTAGGAGT ATTTGAAAGCTCAGT | SEQ ID NO: 2914 | Homo sapiens signal transducing adaptor molecule (SH3 domain and ITAM motif) 2 (STAM2), mRNA [NM_005843] |
| 563 | A_24_P630039 | AL049321 | AACATGAGACAATACAAAGTTACATTTTTGGACCATATATAAAAGT GGAAGAAGACAGGCG | SEQ ID NO: 2915 | Homo sapiens mRNA; cDNA DKFZp564D156 (from clone DKFZp564D156). [AL049321] |
| 564 | A_24_P68027 | APOBEC3B | GCTGCCCGGCATCTATGATTACGACCCCTATATAAGGAGGCGCTG CAAATGCTGCGGAT | SEQ ID NO: 2916 | Homo sapiens apolipoprotein B mRNA editing enzyme, catalytic polypeptide-like 3B (APOBEC3B), mRNA [NM_004900] |
| 565 | A_24_P66125 | STAG2 | TAATCATTCCATGGCCTTAATATGGTTGCAATACAAGAATATCTTC AGATGGGTGAATACC | SEQ ID NO: 2917 | Homo sapiens stromal antigen 2 (STAG2), transcript variant 4, mRNA [NM_006603] |
| 566 | A_24_P675947 | ENST00000389400 | CTTCATGGGCGAAGGTAGCAGTTCTGGAAAGCTACTGAGAAGAG ACAGAGTTCTAAAGTT | SEQ ID NO: 2918 | similar to 40S ribosomal protein S3a (V-fos transformation effector protein) (LOC391706), mRNA [Source:RefSeq_dna;Acc:XR_017186] [ENST00000389400] |
| 567 | A_24_P681266 | A_24_P681266 | TAAGCAGAAAAGCACGAGATGATATATCGTTCCTGAGTTGGTGA TTCAAGTCGGCTTTCC | SEQ ID NO: 2919 | |
| 568 | A_24_P688133 | AK124299 | TAGCATATCTGCAGGAAAAATATCTTGTTGTTGATATGCCCCA ATAGTGATTGATTTC | SEQ ID NO: 2920 | Homo sapiens cDNA FLJ42306 fis, clone TRACH2001646. [AK124299] |
| 569 | A_24_P703614 | A_24_P703614 | AAGAACATTACCGGATGGAGTCTGCACTGTAAGTCATCAGTAGG AGCTTTGTGTGTGTG | SEQ ID NO: 2921 | |
| 570 | A_24_P71468 | QPCT | GTGTGGAAAGATCTATCCTATAGATCATCCTATTCTTATGTGTCT TTGGTTATCGATCA | SEQ ID NO: 2922 | Homo sapiens glutaminyl-peptide cyclotransferase (glutaminyl cyclase) (QPCT), mRNA [NM_012413] |
| 571 | A_24_P71938 | SMAD1 | TGTATTCATATGGTCGTACATTGAGTAGTACTTTTATTCCAAAA GTAGTGGGTTTCTG | SEQ ID NO: 2923 | Homo sapiens SMAD family member 1 (SMAD1), transcript variant 1, mRNA [NM_005900] |
| 572 | A_24_P725898 | THC2706471 | GTCTGAGGACACTTAGTGCTCGTACATTGAACAAGAAGCCATCATTGGTCTT TTGTCCAGAATTTGC | SEQ ID NO: 2924 | |
| 573 | A_24_P75158 | PTAR1 | CCATTAGATTTGTTGTTATGTGACGATGTACGAAGCCAGCTATAA AGTATTGTATTCTG | SEQ ID NO: 2925 | Homo sapiens mRNA; cDNA DKFZp313P0917 (from clone DKFZp313P0917). [AL832683] |
| 574 | A_24_P781846 | AK024092 | ACTTTTTATAGATACAAATGTATCGTGGTAGTAGTAGAAGGACTTT GTTACTTTGGCGTGG | SEQ ID NO: 2926 | Homo sapiens cDNA FLJ14030 fis, clone HEMBA1004086. [AK024092] |
| 575 | A_24_P781829 | THC2543120 | TTTTCCGTTTTGCTAAATGCTAGGTATTGCTTAGGTGTGTTTCT GATGTCATGGATTCT | SEQ ID NO: 2927 | |

Fig. 7-32

| No. | Probe ID No. | Symbols of genes | Sequence | SEQ ID NO: | Descriptions of genes (letters and numbers within [ ] indicates GenBank accession No.) |
|---|---|---|---|---|---|
| 576 | A_24_P792734 | PSMC6 | AGAACGTTAACGGAGTTACTGAATCAAATGGATGATTTGATACTCTGATAGAGTTAAA | SEQ ID NO: 2928 | Homo sapiens proteasome (prosome, macropain) 26S subunit, ATPase, 6 (PSMC6), mRNA [NM_002806] |
| 577 | A_24_P80915 | BCLAF1 | AACTTGTGTCAATGAATGGTAATGAGACCAAACTTGTACATTTAATTAAGGGTACCAGTC | SEQ ID NO: 2929 | Homo sapiens BCL2-associated transcription factor 1 (BCLAF1), transcript variant 1, mRNA [NM_014739] |
| 578 | A_24_P82630 | SMCHD1 | TGTTTAATATGTAACACGTAAGAAGAATTGAAATTTCTCTAAGATTAATACTAGTCT | SEQ ID NO: 2930 | Homo sapiens mRNA for KIAA0650 protein, partial cds. [AB014550] |
| 579 | A_24_P859859 | THC2553238 | TTAACCAGACGTCTGCACCCTTTTCTGATATACTGAGGACACTCGGTCTCTAGCAAT | SEQ ID NO: 2931 | 1305349A cystic fibrosis antigen. [Homo sapiens] (exp=-1; wgp=0; cg=0) partial (65%) [THC2553238] |
| 580 | A_24_P87201 | AK022997 | CTGACATGTGATAAATATTTGAGTGACTTTCAGATTATTCTTGTTAGCGCTGTGTC | SEQ ID NO: 2932 | Homo sapiens cDNA FLJ12935 fis, clone NT2RP2004982. [AK022997] |
| 581 | A_24_P886040 | DCP2 | CATTTGGAACAGGTTTCATTCTGTTCTAGATTTATGTGTTGTAGTTGAACAGGAACTG | SEQ ID NO: 2933 | Homo sapiens DCP2 decapping enzyme homolog (S. cerevisiae) (DCP2), mRNA [NM_152624] |
| 582 | A_24_P890536 | CR627148 | AATTGCCTTCTTGTAACCTAAGTATGGTGAAGCAGAATTGAAATCTAGAAAAGTCTTTC | SEQ ID NO: 2934 | Homo sapiens mRNA; cDNA DKFZp779F2127 (from clone DKFZp779F2127) [CR627148] |
| 583 | A_24_P915269 | SRGN | GCATCATATTCGGAAATATCTTCCTAGGGTTTATCTACCATTTAGTGTTGTTTAGTGAGAC | SEQ ID NO: 2935 | Homo sapiens serglycin, mRNA (cDNA clone IMAGE:4668573), complete cds. [BC022313] |
| 584 | A_24_P91916 | NXT2 | AACGATGTTTCCTTGTAGTACTGATTGAAACTTACACAGTTTATTCTAGTCATAGTGAGC | SEQ ID NO: 2936 | Homo sapiens nuclear transport factor 2-like export factor 2 (NXT2), mRNA [NM_018698] |
| 585 | A_24_P921386 | CALD1 | TTCGTTGTTTACTGGTTTGACTATAATTCTCTGTTATGTTTAGGAGGTAAAACTGGAAGC | SEQ ID NO: 2937 | Homo sapiens caldesmon 1 (CALD1), transcript variant 1, mRNA [NM_033138] |
| 586 | A_24_P924697 | AK055915 | GGCCAGAATAACCCAAAATTATTCAGACGACGGTTAACTATTATTGGTACTGGCTAAGCAATAC | SEQ ID NO: 2938 | Homo sapiens cDNA FLJ31353 fis, clone MESAN2000264. [AK055915] |
| 587 | A_24_P925505 | CD36 | CGTACCCTGTTACTACCACAGTTGGTCTGTTTATCGTGTAAGTACCAAATATGAATGGC | SEQ ID NO: 2939 | CD36-collagen type 1/thrombospondin receptor (one exon) [human, mRNA Partial, 369 nt] [S67044] |
| 588 | A_24_P935986 | BCAT1 | ATGCTGTGAAGGTTTTGTAGAAGCACAATTAAACATGTAAAATGGCTTTGTTGGTGAAGC | SEQ ID NO: 2940 | Homo sapiens branched chain aminotransferase 1, cytosolic (BCAT1), mRNA [NM_005504] |
| 589 | A_24_P936319 | BC030115 | GAAAGATACGAATGCATTCTATGGTACAACTACTGTCAATAACATCTGATGTTACATGCAG | SEQ ID NO: 2941 | Homo sapiens cDNA clone IMAGE:4801326. [BC030115] |
| 590 | A_24_P937095 | SLC30A1 | TTTGATGTAGGTCGTCACCGATACTATGTGGTAATGGTATTTTGTTTACTAACAAGCTCTG | SEQ ID NO: 2942 | Zinc transporter 1 (ZnT-1) (Solute carrier family 30 member 1). [Source:Uniprot/SWISSPROT:Acc:Q9Y6M5] [ENST00000367000] |
| 591 | A_24_P940426 | QKI | AAGTGTTGAATGAGTCTTAAAAATTATACTACTGTTAAGTGGACCAAGTTTGGTGAAGC | SEQ ID NO: 2943 | Homo sapiens quaking homolog, KH domain RNA binding (mouse) (QKI), transcript variant 4, mRNA [NM_206855] |
| 592 | A_24_P940725 | C6orf111 | AATTATGATTAGTGAGTGGTCTAACAGTTTAAGGGATTGATAACTTACAAGTAGAGTGGG | SEQ ID NO: 2944 | Splicing factor, arginine/serine-rich 130 (Serine-arginine-rich splicing regulatory protein 130) (SRrp130) (SR-rich protein) (SR-related protein). [Source:Uniprot/SWISSPROT:Acc:Q8TF01] [ENST00000369239] |

Fig. 7-33

| No. | Probe ID No. | Symbols of genes | Sequence | SEQ ID NO: | Descriptions of genes (letters and numbers within [ ] indicates GenBank accession No.) |
|---|---|---|---|---|---|
| 593 | A_24_P941643 | PLCB1 | ATGATGTGCAGTTTGTGCCTTTATGTATTTGGCTTGTCTTTGT CGAATGTGTGAAATT | SEQ ID NO: 2945 | Homo sapiens phospholipase C, beta 1 (phosphoinositide-specific) (PLCB1), transcript variant 2, mRNA [NM_182734] |
| 594 | A_24_P942002 | CENTB2 | TGGATTCTCATGGTAGGATTTCTGAGATCTTAATCTAAGCTGCAA AGTTGTCTACTTTTT | SEQ ID NO: 2946 | Homo sapiens centaurin, beta 2 (CENTB2), mRNA [NM_012287] |
| 595 | A_24_P942469 | SPAG9 | AAACAGATGTGTCATAATATTAACTGTCGTAAAGAACACATGTGTCT TGCAAATGCCATGGA | SEQ ID NO: 2947 | Homo sapiens cDNA FLJ26141 fis, clone TST03911. [AK129662] |
| 596 | A_24_P942773 | SLMAP | AAAGTACAATAGAATTCTGGAGTACAGATTAAACTATTTGCACT AACACACGTGACGTG | SEQ ID NO: 2948 | Homo sapiens sarcolemma associated protein (SLMAP), mRNA [NM_007159] |
| 597 | A_24_P943957 | PIP5K3 | TTGGCTCTTATTAGGTATTGTAAATAGTAGGGTTATATCGATATG AGCTTTTGTGATGGC | SEQ ID NO: 2949 | Homo sapiens phosphatidylinositol-3-phosphate/phosphatidylinositol 5-kinase, type III (PIP5K3), transcript variant 2, mRNA [NM_015040] |
| 598 | A_24_P97526 | CMTM6 | GTGGATCTCTAGTTGGTCACTTGGTCACTTAATCTGTTCTTTCTTGTTGAGAAAGA TAGTATGTTCACTGG | SEQ ID NO: 2950 | Homo sapiens CKLF-like MARVEL transmembrane domain containing 6 (CMTM6), mRNA [NM_017801] |
| 599 | A_24_P98109 | SNX10 | AACAGTGGGACAGAGGGTACTACAAAAGCAACCTTTTCTTCATTTTCAG TAAGAGTTTAAAAGC | SEQ ID NO: 2951 | Homo sapiens sorting nexin 10 (SNX10), mRNA [NM_013322] |
| 600 | A_24_P99046 | STK38L | GCTATCTGTCTTTTGTGATGTACAAATAAATGAATTGAGAATTT AGTGCAATAGAGGTCC | SEQ ID NO: 2952 | Homo sapiens serine/threonine kinase 38 like (STK38L), mRNA [NM_015000] |
| 601 | A_32_P100109 | REPS2 | GTGTGGAGAATTGGATCAACTGACTTGTGTATTTTGTTTTAAGT CACGTTGTCGAGAA | SEQ ID NO: 2953 | Homo sapiens RALBP1 associated Eps domain containing 2 (REPS2), transcript variant 1, mRNA [NM_004726] |
| 602 | A_32_P101313 | PTPLAD2 | AAAGTGTGAATAACTGATAGTCATTGGTGTATCATTGATGTATCA CTCAATTTTTGGTAA | SEQ ID NO: 2954 | Homo sapiens protein tyrosine phosphatase-like A domain containing 2 (PTPLAD2), mRNA [NM_001010915] |
| 603 | A_32_P108254 | FAM20A | TCGTGCGTTGCCTTGCTCGGTTTTCCGAAAAGCACTGGCTTCA TCAAGGCACCCACCG | SEQ ID NO: 2955 | Homo sapiens family with sequence similarity 20, member A (FAM20A), mRNA [NM_017565] |
| 604 | A_32_P112452 | BI026064 | CGTGAGGAGGTGTTGATGATCGTCTGTATGTTGCCTTCCAGCTGCG ACATTTTGCAAGTCA | SEQ ID NO: 2956 | BI026064 GNO-MTC374-060201-774-h11 MTC374 Homo sapiens cDNA, mRNA sequence [BI026064] |
| 605 | A_32_P113584 | ZNF292 | GGGCCTTTTGGGTTTATTGAATAGTTCATTTCAGCTGTTTAAGA CTTACTACGAATAAG | SEQ ID NO: 2957 | Zinc finger protein 292. [Source:Uniprot/SWISSPROT:Acc:Q602281] [ENST00000339907] |
| 606 | A_32_P11451 | NMD3 | CAGTTTAGGGCAGTAGGCGTTGTCATAAATATCTTCCTACCA CATCAAAAATGCTGC | SEQ ID NO: 2958 | Homo sapiens NMD3 homolog (S. cerevisiae) (NMD3), mRNA [NM_015938] |
| 607 | A_32_P115220 | C9orf66 | TTCTCAAAAAATGTTTTCGTCACACACCTGGCGTGAATGCTTTTCT CCGGAGAAACACTGA | SEQ ID NO: 2959 | Homo sapiens chromosome 9 open reading frame 66 (C9orf66), mRNA [NM_152669] |
| 608 | A_32_P115565 | ZNF294 | TGTGGTCAGAGGATTATAGTTGAGAGTGAAGTACTATGTGTGAGT TATAGATCTCTGAA | SEQ ID NO: 2960 | Homo sapiens zinc finger protein 294 (ZNF294), mRNA [NM_015665] |
| 609 | A_32_P117313 | DKFZP779L1068 | ATGACTGTAAGATCTGAGAGTATGTTCTTACTACTGCATTCTGTAAT TGCAGTAGTGTAGTC | SEQ ID NO: 2961 | Homo sapiens cDNA clone IMAGE:5555490. [BC103326] |
| 610 | A_32_P118325 | BU567832 | ATTAATTCTGACTAAATGGCATTAAAGGAGGTCTGAGGAATTTGC ATGTCACATTCTGGA | SEQ ID NO: 2962 | AGENCOURT_10399047 NIH_MGC_82 Homo sapiens cDNA clone IMAGE:6614537 5', mRNA sequence [BU567832] |

Fig. 7-34

| No. | Probe ID No. | Symbols of genes | Sequence | SEQ ID NO: | Descriptions of genes (letters and numbers within [ ] indicates GenBank accession No.) |
|---|---|---|---|---|---|
| 611 | A_32_P123204 | AI381562 | AACTGCTAGAAATGGTCTCGTTTAAGGAGTGTCTGCTAATAATGTGATCACTTTTGACTT | SEQ ID NO: 2963 | AI381562 te76g06.x1 Soares_NFL_T_GBC_S1 Homo sapiens cDNA clone IMAGE:2092666 3', mRNA sequence [AI381562] |
| 612 | A_32_P124580 | THC2610143 | ATTAGCTGGGACTAAAACGGAGACATGTTTGTTTGTGAATTCTACCTAAATGTCTCTCTA | SEQ ID NO: 2964 | AA490192  za43f10.r1 Soares_NhHMPu_S1 Homo sapiens cDNA clone IMAGE:823723 5', mRNA sequence [AA490192] |
| 613 | A_32_P125917 | THC2753798 | GCTTATAAAGTGTAAGTGGAGACGCCTAAATTGTGAGTACAAAGTTTCTTTTCAGAACAG | SEQ ID NO: 2965 | BF238843 601904455F1 NIH_MGC_64 Homo sapiens cDNA clone IMAGE:4132429 5', mRNA sequence [BF238843] |
| 614 | A_32_P126023 | THC2559360 | AGTCTTCTAGATTCTCGCTAGGACAAACTGATATGAGGTAGAGATGGTGAAAGATGTTTCAGC | SEQ ID NO: 2966 | ALU6_HUMAN (P39188) Alu subfamily SC sequence contamination warning entry, partial (9%) [THC2559380] |
| 615 | A_32_P128980 | BC062780 | AGATGGGAGACAGAGGAGGTAGTGACAGGAGTAGAAGGCACTGTAGAGCTTTCATATCAT | SEQ ID NO: 2967 | Homo sapiens cDNA clone IMAGE:4700531, partial cds. [BC062780] |
| 616 | A_32_P128894 | MEGF9 | TTTAGACAAGATTTGTAGGACAGCCTGAAATTATATGACTGTTCTCTAGGGCCAATATTCCC | SEQ ID NO: 2968 | Homo sapiens multiple EGF-like-domains 9 (MEGF9), mRNA [NM_001080497] |
| 617 | A_32_P131401 | AI276257 | TCAGAAAAACAGAGTAAGGCACCACTCTGGGAAATTAAGGTAGCTTCGAGTAAGAAGT | SEQ ID NO: 2969 | AI276257 qi65f01.x1 Soares_NhHMPu_S1 Homo sapiens cDNA clone IMAGE:1877209 3', mRNA sequence [AI276257] |
| 618 | A_32_P148824 | C1orf27 | GAAAAACAGAGATGTTATCCTGAGCACAAATTCAGTAAAGAGACTACAAAAGGATGATCTTG | SEQ ID NO: 2970 | Homo sapiens chromosome 1 open reading frame 27 (C1orf27), mRNA [NM_017847] |
| 619 | A_32_P149404 | LOC728371 | GTAAAGCTGTGGAATTCTGTTGATGATGGATGGATGGATGGTGAAGCCCTGCGGGATGAT | SEQ ID NO: 2971 | PREDICTED: Homo sapiens similar to ankyrin repeat domain 20A (LOC728371), mRNA [XR_015273] |
| 620 | A_32_P153725 | KIAA1033 | TTTTGTAAAAGAGATGGCAAGTTTGTTACCTCACTTGAGTGGGGTTTTCCTTTTGCCCCAAT | SEQ ID NO: 2972 | Homo sapiens KIAA1033 (KIAA1033), mRNA [NM_015275] |
| 621 | A_32_P162183 | C2 | GGTTGACTTGACTCATGCTTGTTCACTTTGACATGGAATTGCCAGTTATGAAATTAAT | SEQ ID NO: 2973 | Homo sapiens complement component 2 (C2), mRNA [NM_000063] |
| 622 | A_32_P162250 | ARHGAP18 | AAGTCCTGAATAAGTCTAGTGGAAGAATTATTGTTCTGTGGGTGAAAAAGCTTTTGTTGTG | SEQ ID NO: 2974 | Homo sapiens Rho GTPase activating protein 18 (ARHGAP18), mRNA [NM_033515] |
| 623 | A_32_P164203 | THC2683448 | TTGATGGTCATTGTACGAGCTATTGTATGGATTACTGTGGAGTGCTGTTTACCACATGAT | SEQ ID NO: 2975 | Q7WZG3_PASP1 (Q7WZG3) Ferric uptake regulator, partial (8%) [THC2633448] |
| 624 | A_32_P166272 | THC2650457 | ATACATTTAATTCCTCACGTTTATATTGGGAGAGTTGGGTACAGACTGTCGATTACTGC | SEQ ID NO: 2976 | ALU6_HUMAN (P39188) Alu subfamily SP sequence contamination warning entry, partial (12%) [THC2650457] |
| 625 | A_32_P167122 | RCOR3 | GTATCTGAGGATGGTCTGTAATCTGATTTAGATGATTAGATGCATTAGAGACACAGTAGAAAAAGT | SEQ ID NO: 2977 | Homo sapiens REST corepressor 3 (RCOR3), mRNA [NM_018254] |
| 626 | A_32_P170444 | SUB1 | TAGGTATCTCTCCTGAAATTCTTGGAGTTCATTGTTTTATGGCAGTTAATCCAAGTGAAAG | SEQ ID NO: 2978 | Activated RNA polymerase II transcriptional coactivator p15 (SUB1 homolog) (Positive cofactor 4) (PC4) (p14). [Source:Uniprot/SWISSPROT;Acc:P53999] [ENST00000265073] |
| 627 | A_32_P171313 | GNB4 | GATTTAAGTGTTGTTAGATCTTTGTTACAGAGTGATTCATTGCTCTATTTGTTACAGTGGG | SEQ ID NO: 2979 | Homo sapiens guanine nucleotide binding protein (G protein), beta polypeptide 4 (GNB4), mRNA [NM_021629] |

Fig. 7-35

| No. | Probe ID No. | Symbols of genes | Sequence | SEQ ID NO: | Descriptions of genes (letters and numbers within [ ] indicates GenBank accession No.) |
|---|---|---|---|---|---|
| 628 | A_32_P17163 | ENST00000368149 | TGCTTAGTGAGTTTTAAATCTGAGGTAGATTTTTATTTGTTTTCTGTGTGTGATGAG | SEQ ID NO: 2980 | Rho GTPase-activating protein 18 (MacGAP). [Source:Uniprot/SWISSPROT:Acc:Q8N392] [ENST00000368149] |
| 629 | A_32_P172678 | THC2661509 | ACTTAATCAATGTGTCAAAGATTTCTAGGCATTCTCCATCTCATGGATTCGTTCGTTCC | SEQ ID NO: 2981 | |
| 630 | A_32_P17504 | THC2698682 | ATGTCTATGCTGTTTCACTATGCTGCAAGATGGTTGGTGAAATAATTCCGAGGGTTTCCCGTTGATGCGGAAA | SEQ ID NO: 2982 | |
| 631 | A_32_P177640 | WBSCR19 | AATCTTGTATGCTATTATTACACAGGTGTTGGTGAAGGGAGGATGGTTTTTATCTGTGATAC | SEQ ID NO: 2983 | Homo sapiens Williams Beuren syndrome chromosome region 19 (WBSCR19), mRNA [NM_175064] |
| 632 | A_32_P177685 | THC2632266 | TTTGACTGAGTATTTGTAGATGCTTAATGACTGAAATGAATTTGGAGGGACTGATGAAAG | SEQ ID NO: 2984 | AA665072 nu76a01.s1 NCI_CGAP_Alv1 Homo sapiens cDNA clone IMAGE:1216595, mRNA sequence [AA665072] |
| 633 | A_32_P178966 | ENST00000379426 | GTAATATACAGGGTGAACTCTTTACTGATAGACAAGAGACAACGTGTTAAAAAGTGAATCC | SEQ ID NO: 2985 | Novel protein. [Source:Uniprot/SPTREMBL:Acc:Q5T4T1] [ENST00000379426] |
| 634 | A_32_P180435 | WBSCR19 | CTTTGAATCTTTGTATCTATTATTACAGGTGCTGCTGAAGGGAGCATGTTTTATGTATG | SEQ ID NO: 2986 | Homo sapiens Williams Beuren syndrome chromosome region 19 (WBSCR19), mRNA [NM_175064] |
| 635 | A_32_P184417 | A_32_P184417 | AAGGTCTGTTGGTGTGGTAGGCATTCAGTTATTCCTAATAGTTTATTTAGGTACTATAC | SEQ ID NO: 2987 | |
| 636 | A_32_P184916 | GNB4 | CAATGTGAGAGTGTTACATTTGGAGAGAAGTGTGAAATCTAACCAATCGCTAGCAGCATAT | SEQ ID NO: 2988 | Homo sapiens guanine nucleotide binding protein (G protein), beta polypeptide 4 (GNB4), mRNA [NM_021629] |
| 637 | A_32_P193322 | RICTOR | ACCACATGAGTTTCTTCTTTTTATTTAGTAATACGGCTGGTACAT | SEQ ID NO: 2989 | Homo sapiens rapamycin-insensitive companion of mTOR (RICTOR), mRNA [NM_152756] |
| 638 | A_32_P194032 | LONRF1 | GTTAGATCACGATGGTGCAACATGGTTTTATATTGATGCTGGGGTAGAAACTTTTGTATT | SEQ ID NO: 2990 | Homo sapiens LON peptidase N-terminal domain and ring finger 1 (LONRF1), mRNA [NM_152271] |
| 639 | A_32_P195367 | DKFZP779L1068 | ATATAACCTTGGAATTCTATTCTAATTATGTGTCTGGCTGCTTGTAGTATGCAGTTCGG | SEQ ID NO: 2991 | Homo sapiens cDNA clone IMAGE:5555490. [BC110326] |
| 640 | A_32_P19752 | FAM76B | TTGTGCTTTAGCCTGTTTTCCACTATTAATTAGGCATTTACCAGTAAGGGTCATTTTGAC | SEQ ID NO: 2992 | Homo sapiens family with sequence similarity 76, member B (FAM76B), mRNA [NM_146664] |
| 641 | A_32_P20240 | SP3 | CTTAGGCTGTTAATTGTAGTTTAAATTGCAGTAGTGCCTACTCAGACCCAAAAGTTTTGT | SEQ ID NO: 2993 | Homo sapiens mRNA; cDNA DKFZp686N17231 (from clone DKFZp686N17231). [BX648857] |
| 642 | A_32_P203320 | ROCK1 | AACGGCCATGACTCACTATCGAAGATCAAGCTCATGGAAGGAGTAAAGAAAATATCTCAAAATGAG | SEQ ID NO: 2994 | Homo sapiens Rho-associated, coiled-coil containing protein kinase 1, mRNA (cDNA clone IMAGE:5269982), complete cds. [BC041849] |
| 643 | A_32_P203749 | AF086547 | CACGTGTCTATTCTGTAGACTATCTCGTTAGATTTGTAGATGCATTTTTTGCGGACTT | SEQ ID NO: 2995 | Homo sapiens full length insert cDNA clone ZE12B03. [AF086547] |
| 644 | A_32_P205653 | RPL26L1 | TTGGAATGTCTGGAACATTTCATTTCGTGTTTTGTTGTTAGGTGTGGCTCGTAAATCTACT | SEQ ID NO: 2996 | Homo sapiens ribosomal protein L26-like 1 (RPL26L1), mRNA [NM_016093] |
| 645 | A_32_P210798 | BF513730 | AAACACCTACCTAATCTGACTGCTAAATTTCTAGGTCTTGTTTTAAATAATGCTCAGG | SEQ ID NO: 2997 | BF513730 UI-H-BW1-amy-e-05-0-UI.s1 NCI_CGAP_Sub7 Homo sapiens cDNA clone IMAGE:3071696 3', mRNA sequence [BF513730] |

Fig. 7-36

| No. | Probe ID No. | Symbols of genes | Sequence | SEQ ID NO: | Descriptors of genes (letters and numbers within [ ] indicates GenBank accession No.) |
|---|---|---|---|---|---|
| 646 | A_32_P221552 | BE173582 | ATTTAACTGAGGTAGAGGAGATGTTCTAAATTCGGGGTTTCATAGAATCCCGTGAATCT | SEQ ID NO: 2998 | BE173582 RC2-HT0560-290200-014-F06 HT0560 Homo sapiens cDNA, mRNA sequence [BE173582] |
| 647 | A_32_P224666 | CAPZA2 | AATGCTGTTTGAGATTCTGAAATTAAATGAAAATACTTATTTCAGAAATGCATTTAATG | SEQ ID NO: 2999 | Homo sapiens capping protein (actin filament) muscle Z-line, alpha 2 (CAPZA2), mRNA [NM_006136] |
| 648 | A_32_P226678 | BX114764 | CTCTACATCCTTACGTAGGTAAATTCAGGGATGGGCGCCAGTATTTTGGAGGGGTCCAAATTA | SEQ ID NO: 3000 | BX114764 NCI_CGAP_GCB1 Homo sapiens cDNA clone IMAGp998H182012, mRNA sequence [BX114764] |
| 649 | A_32_P226786 | BC045174 | TTATTGGTGCATGTAAGCCATTATCCTGTCTTAATGAACCGATTAATGCTGTTGATGTT | SEQ ID NO: 3001 | Homo sapiens cDNA clone IMAGE:5273245. [BC045174] |
| 650 | A_32_P228438 | THC2637028 | CTGTCCTATTCCACCCCTAGTAGATGAATAGATAATGCGTTGAACTATTCCTATCACCACAGGT | SEQ ID NO: 3002 | Q8N4F7_HUMAN (Q8N4F7) Ring finger protein 175, partial (12%) [THC2637028] |
| 651 | A_32_P2333 | SUB1 | AGGAAGAAAAGGTATTTCTTTAAATCCAGAACAATGGAGCCAAGGTGACGAACAGATTTC | SEQ ID NO: 3003 | Homo sapiens SUB1 homolog (S. cerevisiae) (SUB1), mRNA [NM_006713] |
| 652 | A_32_P233314 | EXOC8 | AGGATTGGGATTTGGGACATGGACATGTACTATAAAGTCAGTCGTATGTACAGTCAGTCT | SEQ ID NO: 3004 | Homo sapiens exocyst complex component 8 (EXOC8), mRNA [NM_175876] |
| 653 | A_32_P26895 | KIAA1600 | AATTCTTGGTCCTCCGTGGGAGAAACTCTCAGATGGTCATTGTGTACGTACTGTCTCTT | SEQ ID NO: 3005 | KIAA1600 (KIAA1600), mRNA [Source:RefSeq_dna;Acc:NM_020940] [ENST00000369248] |
| 654 | A_32_P31123 | THC2680780 | GATTAGGGAAAGTTCGTCGGGTGCATTAGAATGTCAAGTTCAAGTTTGGTGGCTCATTGTAGGACTG | SEQ ID NO: 3006 | |
| 655 | A_32_P32315 | A_32_P32315 | AAAGTGGGAAGATACGGATTCCAAGTCCTGGATTGTCGTCGTTTGGAAAAAGGTCAGTCCTCA | SEQ ID NO: 3007 | |
| 656 | A_32_P3742 | RFX3 | CCTGTCGAAAATTGGCAGGAGCTAAATAATAGTTTGTGGGGGATTTGTATTGTGTAGTGTA | SEQ ID NO: 3008 | Transcription factor RFX3. [Source:Uniprot/SWISSPROT;Acc:P48380] [ENST00000382004] |
| 657 | A_32_P38745 | THC2656841 | AAAGTTGGTATTGGTACCAGATCCGTGCATGCCACTTACGTCTGTGTTTCCTCTCTAATTGGT | SEQ ID NO: 3009 | |
| 658 | A_32_P43217 | PSMA6 | TTGTTTGTTAGTTTACCAGATGCTTACCAAGTTCAATGCCACTTACGACTGTCGAACTCACAGTGTCAAAAATGGAAGAAAAACTACAG | SEQ ID NO: 3010 | Homo sapiens proteasome (prosome, macropain) subunit, alpha type, 6 (PSMA6), mRNA [NM_002791] [NM_004833] |
| 659 | A_32_P44394 | AIM2 | GAAGGAGATAAGGTTCGACTACATTCTCCAACTGCTGTCAAAAAATGGAGAAAAAACTACAG | SEQ ID NO: 3011 | Homo sapiens absent in melanoma 2 (AIM2), mRNA [NM_004833] |
| 660 | A_32_P49164 | AV714556 | AAATGCAGAGCTTGTTATTTGCCAAAGAAGAGATTCATCATGTTCCTTCCTTTGTTTTCCG | SEQ ID NO: 3012 | AV714556 AV714556 DCB Homo sapiens cDNA clone DCBAOD906_5, mRNA sequence [AV714556] |
| 661 | A_32_P6107 | A_32_P6107 | ATGTAATGAATGTCAGAAAGCCTTTGGTGATAGGTCAGCTCTAAAGTACACAGAGAAT | SEQ ID NO: 3013 | |
| 662 | A_32_P61145 | AK096154 | GATAGGATCTTAACAGTAAGCTCTTTATAATTCAACAATGTGATCTTTACTCCTACCC | SEQ ID NO: 3014 | Homo sapiens cDNA FLJ38835 fis, clone MESAN2002424. [AK096154] |
| 663 | A_32_P61857 | KIAA1468 | TCAGTGTACAGTTCCACTGGAATTTGACAGTTGTCTCTACAGTCATGCAACTCGAAGTAG | SEQ ID NO: 3015 | Homo sapiens KIAA1468 (KIAA1468), mRNA [NM_020854] |
| 664 | A_32_P62342 | GLT8D3 | TGTGATGTGTAACTGATGTAACCATTGACAATGTCAATGTGTGCCCTTTATACATTTCATCTCTG | SEQ ID NO: 3016 | Homo sapiens glycosyltransferase 8 domain containing 3, mRNA (cDNA clone MGC:21651 IMAGE:4508300), complete cds. [BC039145] |

Fig. 7-37

| No. | Probe ID No. | Symbols of genes | Sequence | SEQ ID NO: | Descriptions of genes (letters and numbers within [ ] indicates GenBank accession No.) |
|---|---|---|---|---|---|
| 665 | A_32_P63113 | THC2706386 | AGAAAAAGAACAGAAGTCTGGGGTCCACACATAGTGTTTCCAGATGACTGTATTTT | SEQ ID NO: 3017 | Q9T6M0_GLOPA (Q9T6M0) NADH-ubiquinone oxidoreductase subunit 1, partial (6%) [THC2706386] |
| 666 | A_32_P66881 | TLR4 | TTACTGAGTGTTCAGAGTGTGTTTGGTTTGAGCAGGTCTAGGGTGATTGAACATCCCTG | SEQ ID NO: 3018 | Homo sapiens toll-like receptor 4 (TLR4), mRNA [NM_138554] |
| 667 | A_32_P7118 | PSMC6 | AGCAGACCTGAGAAATGTTTGTACTGAAGCAGGTATGTTGGCAATTCGTGCTGATCATGA | SEQ ID NO: 3019 | Homo sapiens proteasome (prosome, macropain) 26S subunit, ATPase, 6 (PSMC6), mRNA [NM_002806] |
| 668 | A_32_P73222 | AA631847 | TTTCTTTGTTTGGACAATCTCATAAGAACTTAAGGTCTTACAAGCACGAACCCCTCGAAG | SEQ ID NO: 3020 | np61b02.s1 NCI_CGAP_Br2 Homo sapiens cDNA clone IMAGE:1130763 3' similar to TR:Q9T1838 Q9T1838 60S RIBOSOMAL PROTEIN L34 ;, mRNA sequence [AA631847] |
| 669 | A_32_P75115 | BF373107 | AGAAGTGAAAAACTGAAGAATGTGGAGTGTTTACTGTCCGGTTACTGACAGACGTGCT | SEQ ID NO: 3021 | BF373107 CM2-FT0123-280700-305-C12 FT0123 Homo sapiens cDNA, mRNA sequence [BF373107] |
| 670 | A_32_P79396 | PBEF1 | AGGGCCGATTATCTTTACATAGGACGACAGGCCAGGAATTTGTTACACTGGAAGAAGGAA | SEQ ID NO: 3022 | Homo sapiens pre-B-cell colony enhancing factor 1 (PBEF1), mRNA [NM_005746] |
| 671 | A_32_P81768 | TMEM167 | CCTCAGGTACTGTCACTACAATATTACATTCTGCAAATGTTATTCTGTTGTATCAGATACG | SEQ ID NO: 3023 | Homo sapiens transmembrane protein 167 (TMEM167), mRNA [NM_174909] |
| 672 | A_32_P83000 | FLJ31222 | ACCATCTGCTGGGACGGAGACCTCTCTTGATCTCACTCCCAGAAAAGACTGAA | SEQ ID NO: 3024 | Homo sapiens cDNA FLJ31222 fis, clone KIDNE2004294. [AK055784] |
| 673 | A_32_P83256 | AK023663 | CAAATAGTCCTTCAAAGCATCTTCAGAATCAAGATTGTCATCTAGATTGCACCCGAAGTT | SEQ ID NO: 3025 | Homo sapiens cDNA FLJ13601 fis, clone PLACE1010069. [AK023663] |
| 674 | A_32_P86400 | LYSMD3 | AAATGTTGCTCAGGTAATCAGTATTTTCTTCGACGTATGTCATATTGCACTGTTAGATC | SEQ ID NO: 3026 | Homo sapiens LysM, putative peptidoglycan-binding, domain containing 3 (LYSMD3), mRNA [NM_198273] |
| 675 | A_32_P877 | BM999343 | TAAAATGCTTGCAGAACTGCACTGTCATTCTCAGAGATTTCCATGGGAAGCCATGCCTA | SEQ ID NO: 3027 | BM999343 UI-H-DPO-avf-i-24-0-UI.s1 NCI_CGAP_Fs1 Homo sapiens cDNA clone IMAGE:5878751 3', mRNA sequence [BM999343] |
| 676 | A_32_P97046 | BU076193 | ATTTATATAGACGATGGGGCAGGCTAATGACATCATAACATTAACTTTTCCAAAGAAGT | SEQ ID NO: 3028 | im55f06.x1 HR85 islet Homo sapiens cDNA clone IMAGE:6038939 3', mRNA sequence [BU076193] |
| 677 | A_32_P98435 | PCMTD1 | ACACTTTGCCATGGTCAAAGAATGAAGGAGAATATGGAAAAGCCAATCTTCAAATATATC | SEQ ID NO: 3029 | Homo sapiens clone 122482 unknown mRNA. [AF293366] |

Fig. 8-1

| No. | Probe ID No. | Symbols of genes | Sequence | SEQ ID NO: | Descriptions of genes (letters and numbers within [ ] indicates GenBank accession No.) |
|---|---|---|---|---|---|
| 1 | A_23_P341938 | NOG | GCCAGGGGTGCGGCTGGATTCGCATCCAGTACCCATCATTTCCGAGTGCAATGCTCGT | SEQ ID NO: 2373 | Homo sapiens noggin (NOG), mRNA [NM_005450] |
| 2 | A_24_P413126 | TMEPAI | AAGAAAGTGCTTGTTGTGTATCAGTAATCATTAGTGGCAATGATGACATTCTGAAAAGCT | SEQ ID NO: 2404 | Homo sapiens transmembrane, prostate androgen induced RNA (TMEPAI), transcript variant 1, mRNA [NM_020182] |
| 3 | A_32_P111394 | THC2643957 | GAATACAGGTGTTCCTTTCATCCCATATTTGAGTGAACCTAAGACACATCAATTATAAGG | SEQ ID NO: 2418 | |
| 4 | A_32_P125589 | THC2649341 | CGGTCTATCCCTTGCTTTAGCCTTTTGAATGAAAGTGAGATGTCTCATCAGCTCAGATAG | SEQ ID NO: 2419 | |
| 5 | A_32_P164378 | THC2703271 | GAAAGAACATGAAAAGCATTGGAATGAAGGAAAGCCAGCTGGTTTAGACTTTAATTTG | SEQ ID NO: 2426 | |
| 6 | A_32_P178998 | DMRTC1 | ATATGCAGGAGTTTTATTGGTGTTGATTGCTGCTGAGATACCTGTGCAGTCAGTGTGTATA | SEQ ID NO: 2430 | Homo sapiens DMRT-like family C1 (DMRTC1), mRNA [NM_033053] |
| 7 | A_23_P111321 | ARG1 | TGGAATCAGGAGGACAAAGGTACCACACATGTGGAAAGGTAGTATGTGTCCATGTCATTCAAA | SEQ ID NO: 2459 | Homo sapiens arginase, liver (ARG1), mRNA [NM_000045] |
| 8 | A_23_P11201 | GPR34 | AGTAGGAGTGAAAAGCACTTGAGAATTTAAACCAGGATACTCCCTGCATGATACATCTGTG | SEQ ID NO: 2461 | Homo sapiens G protein-coupled receptor 34 (GPR34), transcript variant 1, mRNA [NM_005300] |
| 9 | A_23_P19222 | RETN | CAATAAGGACGTTGGCCTGGACTGCCAGAGGGTCACCTCCAGGGGGGACCTGGCTACTT | SEQ ID NO: 2469 | Homo sapiens resistin (RETN), mRNA [NM_020415] |
| 10 | A_23_P121716 | ANXA3 | TGGACATTCGAACAGAGTTGAAGAAAGCATTATGGGCTATTCCCTATATTCAGGAATTAAAT | SEQ ID NO: 2475 | Homo sapiens annexin A3 (ANXA3), mRNA [NM_005139] |
| 11 | A_23_P14708 | SUHW4 | TCTTTGTTACCTCCATACAAGTGTTAGCCTGCCAGGCTGTAAGCTTACGTTAATTAAGCT | SEQ ID NO: 2507 | Homo sapiens suppressor of hairy wing homolog 4 (Drosophila) (SUHW4), transcript variant 1, mRNA [NM_017661] |
| 12 | A_23_P151637 | RNASE2 | GTGGTAACCGCAAATATGACCTGTCCTAGTAACAAAAGTCGCAAAAATTGTCACCACAGTG | SEQ ID NO: 2514 | Homo sapiens ribonuclease, RNase A family, 2 (liver, eosinophil-derived neurotoxin) (RNASE2), mRNA [NM_002934] |
| 13 | A_23_P152002 | BCL2A1 | TGTAACGTATATTTGCATTTGAAGGTATTCCATCAAGAAACTTCTACGACAGGCAAATTGC | SEQ ID NO: 2516 | Homo sapiens BCL2-related protein A1 (BCL2A1), mRNA [NM_004049] |
| 14 | A_23_P159650 | COX7B | CAAAATACGGCTAATGCTGTGTATTAGCTAGTGGAGCCACTTTCTGTATTGTTACAGATGGACATA | SEQ ID NO: 2525 | Homo sapiens cytochrome c oxidase subunit VIIb (COX7B), nuclear gene encoding mitochondrial protein, mRNA [NM_001866] |
| 15 | A_23_P170233 | CSTA | AACTGGCTACTGAGTCATGATCGTTGCTGATAAATATAACCATCAATAAGAAGCATTCT | SEQ ID NO: 2543 | Homo sapiens cystatin A (stefin A) (CSTA), mRNA [NM_005213] |
| 16 | A_23_P25235 | CLEC4D | CATTTAACCCACGAGAGTATTCTGGCATAAGAATGAACCCGACAACTGTCAGGGGAGAAA | SEQ ID NO: 2600 | Homo sapiens C-type lectin domain family 4, member D (CLEC4D), mRNA [NM_080387] |
| 17 | A_23_P263012 | GRAMD1C | GAATTCCAAGAAGGATACGTAGGGGGTAACAGTGAACCTACCTGGGTTTGTTTTGTTTTG | SEQ ID NO: 2602 | Homo sapiens GRAM domain containing 1C (GRAMD1C), mRNA [NM_017577] |
| 18 | A_23_P302550 | RGS18 | GAGTCGTAAGGCCCTAGGCGATTTGGGCATCTGCCACATTGGTTCATATTGGAGAAAGTGTTA | SEQ ID NO: 2621 | Homo sapiens regulator of G-protein signalling 18 (RGS18), mRNA [NM_130782] |

Fig. 8-2

| No. | Probe ID No. | Symbols of genes | Sequence | SEQ ID NO: | Descriptions of genes (letters and numbers within [ ] indicates GenBank accession No.) |
|---|---|---|---|---|---|
| 19 | A_23_P307940 | CAPZA2 | CTACAAGATTGGCAAAGAGATGCATAAGATGAACATT GCATGACCGGATCATT | SEQ ID NO: 2628 | Homo sapiens capping protein (actin filament) muscle Z-line, alpha 2 (CAPZA2), mRNA [NM_006136] |
| 20 | A_23_P314191 | ZDHHC17 | TGGATACTTTAGCAAATAGGAACTTAATTCTCAGGACTGAACA TGAATTACTTCCTTGG | SEQ ID NO: 2634 | Homo sapiens zinc finger, DHHC-type containing 17 (ZDHHC17), mRNA [NM_015336] |
| 21 | A_23_P324633 | C9orf72 | TTTGTGGATTTAGTCCCTGGGATTCAGTCTGTAGAAATGTCTAA TAGTTCTCTATAGTCC | SEQ ID NO: 2640 | Homo sapiens chromosome 9 open reading frame 72 (C9orf72), transcript variant 1, mRNA [NM_018325] |
| 22 | A_23_P347198 | SP3 | GACGAGCTCAAATTTAAAGGGCTACGTTATTGTGACGTTTAAAGTG TATTATAACAGTGTGG | SEQ ID NO: 2651 | Homo sapiens Sp3 transcription factor (SP3), transcript variant 1, mRNA [NM_003111] |
| 23 | A_23_P349083 | FCHO2 | GTGAAATGTTAAACTGTGCACTTCTTAGTTACCACAGTCTT CATACCAAGTATTGGG | SEQ ID NO: 2652 | Homo sapiens FCH domain only 2 (FCHO2), mRNA [NM_138782] |
| 24 | A_23_P405873 | C9orf72 | GAGAATGGAAGATCAGGGTCAGAGTATTATTCCAATGCTTACTG GAGAAGTGATTCCTGT | SEQ ID NO: 2674 | Homo sapiens chromosome 9 open reading frame 72 (C9orf72), transcript variant 2, mRNA [NM_145005] |
| 25 | A_23_P41114 | CSTA | AAACAAATGAGACTTATGGAAGCTGTGCAGTATAAA ACTCAAGTTGTTGCTG | SEQ ID NO: 2677 | Homo sapiens cystatin A (stefin A) (CSTA), mRNA [NM_005213] |
| 26 | A_23_P41664 | ENST00000334994 | TGGCTTGGAGGCAGATTCGACTTCATAAACAAATGTTCGTGAAAA ATGAGGCACAGGTCAT | SEQ ID NO: 2680 | Synleurin (CGL01891) [Source:Uniprot/SPTREMBL;Acc:Q72207] ENST00000334994 |
| 27 | A_23_P420431 | XKR3 | CAGAGGTGGGCCATAGAATCCTACAGTACAGCTTCAGTTTTT TAGAAAATGTGATAAT | SEQ ID NO: 2681 | Homo sapiens XK, Kell blood group complex subunit-related family, member 3 (XKR3), mRNA [NM_175878] |
| 28 | A_23_P434809 | S100A8 | AAAAGCCATGAAGAAAGCCACAAAGAGTAGCTGAGGTTACTGGGACC CAGAGGGCTGGGCCCT | SEQ ID NO: 2691 | Homo sapiens S100 calcium binding protein A8 (S100A8), mRNA [NM_002964] |
| 29 | A_23_P44257 | COMMD8 | AACATTTTAGTTCTGCGCTTCTATGTTTGGGAAAACATTGCTCTG ATAAAAATAGCTGTC | SEQ ID NO: 2692 | Homo sapiens COMM domain containing 8 (COMMD8), mRNA [NM_017845] |
| 30 | A_23_P50907 | ITGAV | AAAGAGTGATTAAGTGAGGTTATTTACCCCTAAATGGTCCATTC TGGATTGTATTTGAGG | SEQ ID NO: 2700 | Homo sapiens integrin, alpha V (vitronectin receptor, alpha polypeptide, antigen CD51) (ITGAV), mRNA [NM_002210] |
| 31 | A_23_P59637 | DOCK4 | TTTGGCAGTGAGCAGTTAAGTGAGGTTATCTTGAATTTATGATGTGTG TGTATTTCTGAAGCAG | SEQ ID NO: 2714 | Homo sapiens dedicator of cytokinesis 4 (DOCK4), mRNA [NM_014705] |
| 32 | A_23_P59921 | SUB1 | CAGATTGGGAAAATGAGGTACGTTAGTGTTCGCGATTTTAAAGG CAAAGTGGTAATTCAT | SEQ ID NO: 2715 | Homo sapiens SUB1 homolog (S. cerevisiae) (SUB1), mRNA [NM_006713] |
| 33 | A_23_P63343 | UTS2 | AGAATCTGGAAACCATACACAAGAAAACGTGAGACTTCCTGATTGTT CTGGAAATACTGTGTC | SEQ ID NO: 2719 | Homo sapiens urotensin 2 (UTS2), transcript variant 1, mRNA [NM_021995] |
| 34 | A_23_P63768 | C15orf15 | TCCTGGATTGCCATCTACATTAGATAATATCACGATATTACGGATGTTAG ATTGCATCTCCAGTGTT | SEQ ID NO: 2723 | Homo sapiens chromosome 15 open reading frame 15 (C15orf15), mRNA [NM_016304] |
| 35 | A_23_P66260 | ZNF267 | TGTGATGAATGTGGTAAAGCCTCAGCTATGAAGGTCATACCCTCAC TACAACATGGAGAAGT | SEQ ID NO: 2724 | Homo sapiens zinc finger protein 267 (ZNF267), transcript variant 498723, mRNA [NM_003414] |
| 36 | A_23_P74001 | S100A12 | TGAAGGTTTTACCCAGCAATGTCCTCAATGAGGGTCTTTTCT TTCCGTCACGAAAACC | SEQ ID NO: 2738 | Homo sapiens S100 calcium binding protein A12 (S100A12), mRNA [NM_005621] |
| 37 | A_23_P7543 | ZFYVE16 | TGTGGCTCGAGCATTATGTAAATGATCTTGATAGTGCTGTGATAC CTGTGATCCATGGTGG | SEQ ID NO: 2740 | Homo sapiens zinc finger, FYVE domain containing 16 (ZFYVE16), mRNA [NM_014733] |
| 38 | A_23_P78092 | EVI2A | GCTGAATCAGACACTTGGAAAAGACAAAGACTCACAGGACC CAACGTAGTGATGGAA | SEQ ID NO: 2746 | Homo sapiens ecotropic viral integration site 2A (EVI2A), transcript variant 1, mRNA [NM_001003927] |

Fig. 8-3

| No. | Probe ID No. | Symbols of genes | Sequence | SEQ ID NO: | Descriptions of genes (letters and numbers within [ ] indicates GenBank accession No.) |
|---|---|---|---|---|---|
| 39 | A_23_P82047 | BU507302 | TCTGTTTGGTTAATGTCAAGCTGCCTGAAGATTGAGCAGTTTATAAATTGGTTAATTTGTG | SEQ ID NO: 2748 | AGENCOURT_IC309688 NIH_MGC_71 Homo sapiens cDNA clone IMAGE:6501220 5', mRNA sequence [BU507302] |
| 40 | A_23_P94230 | LY96 | TGAAGCTATTTCTGGGAGCCCAAGAAGAAATGTCTTTTGCTTGGAGTTTGTGATCGTACA | SEQ ID NO: 2763 | Homo sapiens lymphocyte antigen 96 (LY96), mRNA [NM_015364] |
| 41 | A_24_P105648 | BX111927 | TTATGAGATGCTCAGTTGAGTTCAAATAACAGTGCAGTAATTCACCTATATGTAAAAGACTGCC | SEQ ID NO: 2778 | BX111927 Soares_multiple_sclerosis_2NbHMSP Homo sapiens cDNA clone IMAGp998G05619, mRNA sequence [BX111927] |
| 42 | A_24_P11045 | THC2785765 | CCACCAGAAACGTACACCTGATTTTCATGACAAATACGGTAGCAACAGAAGTCGGGAATAG | SEQ ID NO: 2781 | COX7B_HUMAN (P24311) Cytochrome c oxidase polypeptide VIIb, mitochondrial precursor partial (78%) [THC2785765] |
| 43 | A_24_P201702 | CLEC2B | ATTGGAATTCAAGTAATAACAACTGTTCCACTCAACATGCCGACCTAACTATAATTGACA | SEQ ID NO: 2815 | Homo sapiens C-type lectin domain family 2, member B (CLEC2B), mRNA [NM_005127] |
| 44 | A_24_P20996 | BC043173 | CTGGAAAATGTTCATATATATGTATATGAATGTGTCTTTATGGTGAAGGGCTCTGATTGG | SEQ ID NO: 2818 | Homo sapiens cDNA clone IMAGE:5287121. [BC043173] |
| 45 | A_24_P235429 | ABCA1 | GCAAAGAGCCATGTGTCATGTAATACTGAACCACTTGATATTGAGACATTAATTTGTAC | SEQ ID NO: 2823 | Homo sapiens ATP-binding cassette, sub-family A (ABC1), member 1 (ABCA1), mRNA [NM_005502] |
| 46 | A_24_P286054 | ZFYVE16 | GTGTATGTATTCTGCCATGTAAGTAATTGAACAGTCTAAAATAACCAAATGGTAGAAGGG | SEQ ID NO: 2842 | Zinc finger FYVE domain-containing protein 16 (Endofin) (Endosome-associated FYVE domain protein). [Source:Uniprot/SWISSPROT;Acc:Q7Z3T8] [ENST00000380248] |
| 47 | A_24_P320328 | SUB1 | CAGAAAACCTGTAAAGAACAAAAGACAGGTGAGACTTCGAGAGGCCTGTCTATCTTGTA | SEQ ID NO: 2857 | Homo sapiens SUB1 homolog (S. cerevisiae) (SUB1), mRNA [NM_006713] |
| 48 | A_24_P324581 | KIAA1466 | ATAATAGCTCATAGAATGAATTGCTGTACCAACCAAGGCTAAAAGAAATTTAAGTAGCCC | SEQ ID NO: 2861 | Homo sapiens mRNA for KIAA1466 protein, partial cds. [AB040899] |
| 49 | A_24_P387869 | PKN2 | TTGTCCAGAGATCATTTATATTTACGTTCGAAATTGTTTATTACCCAAGATCGTTTGGGAG | SEQ ID NO: 2885 | Homo sapiens protein kinase N2 (PKN2), mRNA [NM_006256] |
| 50 | A_24_P413669 | PFKFB2 | TCAAATGGTTCTTTTATACTGTGGATGATACAGGACTCTGTTACCTAAGATGTGATAAGC | SEQ ID NO: 2898 | Homo sapiens 6-phosphofructo-2-kinase/fructose-2,6-biphosphatase 2 (PFKFB2), transcript variant 2, mRNA [NM_001018053] |
| 51 | A_24_P450172 | AK095151 | TATGCCAGTGAATAAAGGTAGTTCTCTGGACAAGATGCTAACACATTTTACTATTAATCCTAGGGTAC | SEQ ID NO: 2902 | Homo sapiens cDNA FLJ37832 fis, clone BRSSN2009630. [AK095151] |
| 52 | A_24_P45620 | UTS2 | AGAAAGTTTCAGGATTTCTCTGGACAAGATGCTAACACATTTTACTGAGTCATCTTTTGGCC | SEQ ID NO: 2903 | Homo sapiens urotensin 2 (UTS2), transcript variant 1, mRNA [NM_021995] |
| 53 | A_24_P667201 | AK022997 | CTGACATGTGATAAATATTCAGTGAGTTTCAGATTTATTTCTTGTTAGGCGCTGTGTC | SEQ ID NO: 2932 | Homo sapiens cDNA FLJ12935 fis, clone N12RP2004992. [AK022997] |
| 54 | A_24_P890536 | CR627148 | AATTGCTTCTTGTAACCCTAAGTATGGTGAAGCAGAGAATTGAATTCTACAAAAGTCTTTC | SEQ ID NO: 2934 | Homo sapiens mRNA; cDNA DKFZp779F2127 (from clone DKFZp779F2127). [CR627148] |
| 55 | A_32_P153725 | KIAA1033 | TTTTGTAAAAGATGGCAAGTTTGTTACCTCAGTTGAGTCGGGTTTCGTTTTCCGCGAAT | SEQ ID NO: 2972 | Homo sapiens KIAA1033 (KIAA1033), mRNA [NM_015275] |
| 56 | A_32_P164203 | THC2683448 | TTGATGGTCATTGTACGAGCTATTGTATGGATTACGTCAGTTTACCACATGAT | SEQ ID NO: 2975 | Q7WZG3_PASPI (Q7WZG3) Ferric uptake regulator, partial (8%) [THC2683448] |

Fig. 8-4

| No. | Probe ID No. | Symbols of genes | Sequence | SEQ ID NO: | Descriptions of genes (letters and numbers within [ ] indicates GenBank accession No.) |
|---|---|---|---|---|---|
| 57 | A_32_P17504 | THC2693682 | ATGTGTATGCTGTGTTTGAGTATGCTGGAAATATTGCCAGGCTTTT CCCGTTGATGCCAAA | SEQ ID NO: 2982 | |
| 58 | A_32_P178966 | ENST00000379426 | GTAATATACAGAGGGTGAAGTCTTTACTGATACACAAGAGACAAACT GTTAAAAAGTGAATCC | SEQ ID NO: 2985 | Novel protein. [Source:Uniprot/SPTREMBL;Acc:Q5T4T1] [ENST00000379426] |
| 59 | A_32_P224666 | CAPZA2 | AATGCTGTTTGAGATTCTGAAATTAAATGAAAATAGTTATTTC AGAAATGCATTTAATG | SEQ ID NO: 2999 | Homo sapiens capping protein (actin filament) muscle Z-line, alpha 2 (CAPZA2), mRNA [NM_006136] |
| 60 | A_32_P226786 | BC045174 | TTATTGGTGCATGTAAGCCATTATCCGTGTCTTAATGAACGGATT AATGGTTGATTGTT | SEQ ID NO: 3001 | Homo sapiens cDNA clone IMAGE:5273245. [BC045174] |
| 61 | A_32_P2333 | SUB1 | AGGAAGAAAACGTATTCTTTAAATCCAGAACAATGGAGCCAGC TGACAGAACGATTTC | SEQ ID NO: 3003 | Homo sapiens SUB1 homolog (S. cerevisiae) (SUB1), mRNA [NM_006713] |

Fig. 21-1

| No. | Probe ID No. | Symbols of genes | Sequence | SEQ ID NO: | Descriptions of genes (letters and numbers within [ ] indicates GenBank accession No.) |
|---|---|---|---|---|---|
| 1 | A_23_P341938 | NOG | GCCAGCGCCTGGGCCTGGAATTCCGATCGAGTAGCCCATCGATTTCC GAGTGCAAGTGCTGGT | SEQ ID NO: 3030 | Homo sapiens noggin (NOG), mRNA [NM_005450] |
| 2 | A_23_P359174 | BC069659 | CCAAGGGGTGCATACTAGGGTAAAGAAAAATTTGTGATAAGGAAC AGTGGTTTGGGATTTT | SEQ ID NO: 3031 | Homo sapiens cDNA clone IMAGE:7262526, with apparent retained intron. [BC069659] |
| 3 | A_24_P15797 | NUDT22 | CGCGGCGTCACATTCTCATTGGGGTGGATGCAAGACCACGGTCC ACCTGTCAGGAAAAAA | SEQ ID NO: 3032 | Homo sapiens cDNA FLJ34477 fis, clone HLUNG2003833. [AK091796] |
| 4 | A_24_P930391 | AK022351 | AAGTGGGTTTAATTTCTTTTCATGAAAGGAAAGATTAGCTTTC ATGCAAACACTTGGTC | SEQ ID NO: 3033 | Homo sapiens cDNA FLJ12289 fis, clone MAMMA1001788. [AK022351] |
| 5 | A_24_P931364 | AK022062 | TCCCATCGTGGAGTATGGTTTGGAAGTCATTGCTTTGTAGTAAG GCATTATTTCCTGGT | SEQ ID NO: 3034 | Homo sapiens cDNA FLJ12000 fis, clone HEMBB1001531. [AK022062] |
| 6 | A_32_P111394 | THC2643957 | GAATACAGTGTTCCTTTCATCCCATATTTGACTGAACGTAAGA CACATCAATTATAAGG | SEQ ID NO: 3035 | |
| 7 | A_32_P125589 | THC2649341 | CGCTCTATCCGTTGCTTTAGCCTTTTGAATGAAAGTGAGATGTC TCATCAGCTCAGATAG | SEQ ID NO: 3036 | |
| 8 | A_32_P142802 | THC2699446 | CGGCCGCAAGCACATCCGAAGAAAAGGGGTCAGGTATTCTAGGCG TACGGGGACTGATAAA | SEQ ID NO: 3037 | |
| 9 | A_32_P19561 | THC2728305 | AAGAAGGGACAGTTACAACAGTAATTGGGAAAAGCTTCTGAAGGA CAGATGTGCATTTCTC | SEQ ID NO: 3038 | |
| 10 | A_32_P209682 | THC2663167 | CAATGTAAAGCCAGAATATCAAGGTCGTTTGTCAAGATTTTGA AACGTATTTGGCTGGT | SEQ ID NO: 3039 | ALU1_HUMAN (P39188) Alu subfamily J sequence contamination warning entry, partial (5%) [THC2663167] |
| 11 | A_32_P226941 | THC2689491 | ACACCTACTACAGGCTCAGAACTACTATAGTTGAGTAAGCTTGGG ATGTGGAGTAGGCCCA | SEQ ID NO: 3040 | |
| 12 | A_32_P33304 | ANK3 | TGTTGGAATACCGGGGGGTGATCTGTCTTTTATAAACTCACCTGA TTTAAAGGAAAGATGA | SEQ ID NO: 3041 | Homo sapiens cDNA FLJ44903 fis, clone BRAMY3005184, highly similar to Mus musculus ankyrin 3, epithelial (Ank3). [AK126851] |
| 13 | A_32_P71171 | A_32_P71171 | TCTAGATAGTAATAGGAAAACCAAGAATCAAGCCTGGTGATGGCT GGAGGGAGTGATTGAA | SEQ ID NO: 3042 | |
| 14 | A_32_P98940 | T-HC2745859 | AAGAGTATTCCAAGATAGGCAAAGGTGTTGTTTTTAGCAGGT GTATTTCAGCTAGTTA | SEQ ID NO: 3043 | |
| 15 | A_23_P41664 | ENST00000334994 | TGGCTTGGAAGCAGATTCGAGTTGATAAACAAATTGTTCCTGAAA ATGAGGCACAGGTCAT | SEQ ID NO: 3044 | Synleurin (QGLQ1891). [Source:Uniprot/SPTREMBL;Acc:Q7Z2O7] ENST00000334994 |
| 16 | A_23_P65768 | C15orf15 | TCCTGCATTGCCATCTACATAATATCAGATATTACGGATGTTAG ATTGCATCGTCAGTGTT | SEQ ID NO: 3045 | Homo sapiens chromosome 15 open reading frame 15 (C15orf15), mRNA [NM_016304] |
| 17 | A_23_P70007 | HMMR | ACTATTTCTTCAGAGTTGTTGTCATATACTGGTTGTCATCTGCATG TGTACTCAGCATTTGA | SEQ ID NO: 3046 | Homo sapiens hyaluronan-mediated motility receptor (RHAMM) (HMMR), transcript variant 1, mRNA [NM_012484] |
| 18 | A_23_P70326 | CENPQ | GAATGGCTTACAGTTTCTGTCTGGTCATCTGAACTTGAAAAAT CCTGAAATGGCTTCAC | SEQ ID NO: 3047 | Homo sapiens centromere protein Q (CENPQ), mRNA [NM_018131] |

Fig. 21-2

| No. | Probe ID No. | Symbols of genes | Sequence | SEQ ID NO: | Descriptions of genes (letters and numbers within [ ] indicates GenBank accession No.) |
|---|---|---|---|---|---|
| 19 | A_23_P78092 | EVI2A | GCTGAATCAGAGACACTTGGAAAGAAGAACAAACAAGGTCACAGGACC CAACGTAGTGATGCAA | SEQ ID NO: 3048 | Homo sapiens ecotropic viral integration site 2A (EVI2A), transcript variant 1, mRNA [NM_001003927] |
| 20 | A_24_P11045 | THC2785765 | CCACCAGAAACGTACAGACCTGATTTTCATGACAAATACGGTAGGCA ACACAAGTCGGAAATAG | SEQ ID NO: 3049 | COX7B_HUMAN (P24311) Cytochrome c oxidase polypeptide VIIb, mitochondrial precursor partial (78%) [THC2785765] |
| 21 | A_24_P126741 | ENST00000309178 | AGGGTCGAACGACGAGTAAGAAGAGTTCAAGATTACTTGCAAGAGC TCACAGGAGCGGAGAAT | SEQ ID NO: 3050 | |
| 22 | A_24_P169378 | RPS7 | AACTGAAATCTTTCCAGAAATCCAAATCGGGCTAGTAAGTGAA TTGGAGAAAAGTTCA | SEQ ID NO: 3051 | Homo sapiens ribosomal protein S7 (RPS7), mRNA [NM_001011] |
| 23 | A_24_P201702 | CLEC2B | ATTGGAATCAAGTAAATACAACTGTTCCACTCAACATGCGGAG CTAACTATAATTGACA | SEQ ID NO: 3052 | Homo sapiens C-type lectin domain family 2, member B (CLEC2B), mRNA [NM_005127] |
| 24 | A_24_P276583 | TMCO1 | CCTTCATTTCCGTGTATATTCTCGTACTATGTCGATTCGGACAG AAGATTCAGAAGAATTC | SEQ ID NO: 3053 | Homo sapiens transmembrane and coiled-coil domains 1 (TMCO1), mRNA [NM_019026] |
| 25 | A_24_P333112 | A_24_P333112 | GGTCATGAGAATCAGAGAGGTATCAATGTGTGAGCCAACAGGACCA AAAGGTATTCGAACTT | SEQ ID NO: 3054 | |

Fig. 24-1

| No. | Probe ID No. | Symbols of genes | Sequence | SEQ ID NO: | Descriptions of genes (letters and numbers within [ ] indicates GenBank accession No.) |
|---|---|---|---|---|---|
| 1 | A_23_P100263 | CMIP | CCCCCGCGGAATTCTTTTAGGTTCGTAATTGGAACCTTTGACCT GATCTAAAGTGGACTT | SEQ ID NO: 3055 | Homo sapiens c-Maf-inducing protein (CMIP), transcript variant C-mip, mRNA [NM_198390] |
| 2 | A_23_P103561 | NAV1 | TCGTCCCGCAAGAGATCTGCCTGGAGCCCAGAAAAACAAGACATGT GGTTTAAAAAATGTTT | SEQ ID NO: 3056 | Homo sapiens neuron navigator 1 (NAV1), mRNA [NM_020443] |
| 3 | A_23_P106122 | RP5-860F19.3 | CAAGCCGCCCCCCAGGTGGCGTCAGTTGCTCTCGCTAAGGTTT GGAGAAACAGAACAA | SEQ ID NO: 3057 | Homo sapiens KIAA1442 protein, mRNA (cDNA clone IMAGE:5502800), complete cds. [BC054347] |
| 4 | A_23_P115161 | DARC | TCCCCCTCAACTGAGAAGTCAAGTCAGCTGGACTTCGAAGATGT ATGAATTGTTCCTAT | SEQ ID NO: 3058 | Homo sapiens Duffy blood group, chemokine receptor (DARC), mRNA [NM_002036] |
| 5 | A_23_P117694 | CORO2B | ATTAGTAGGATCTACTAGATGCATTATACTGCATACGTGGTTT TCCCATGGCCGGCCCTA | SEQ ID NO: 3059 | Homo sapiens coronin, actin binding protein, 2B (CORO2B), mRNA [NM_006091] |
| 6 | A_23_P119143 | ICAM5 | GACGCCCCACAGCTCACACGGGGGCTTATTTATTGGTTTATT ATTTACTTATTCATTT | SEQ ID NO: 3060 | Homo sapiens intercellular adhesion molecule 5, telencephalin (ICAM5), mRNA [NM_003259] |
| 7 | A_23_P142187 | HIF3A | ACCCCCAGCTTTCTTTCTACAGAGATGGTGCTAGTCTTGGTCTCC CACAGGAAAAGGCCTC | SEQ ID NO: 3061 | Homo sapiens hypoxia inducible factor 3, alpha subunit (HIF3A), transcript variant 2, mRNA [NM_022462] |
| 8 | A_23_P144796 | PDLIM4 | TGGTCCCAGGCCTGCTTCTTAAGGTCCCTCGTCGGCCAGGTGTAA ATATGTTTCACCCTGT | SEQ ID NO: 3062 | Homo sapiens PDZ and LIM domain 4 (PDLIM4), mRNA [NM_003687] |
| 9 | A_23_P145681 | ACTL6B | CCCCCCAAACTGGAAGAGAAGAAGGAGAAGCTACCCCAGGTCTCCA AGTCGTGGGCATAAGTA | SEQ ID NO: 3063 | Homo sapiens actin-like 6B (ACTL6B), mRNA [NM_016188] |
| 10 | A_23_P150407 | CREB3L1 | TGGCTGCTGGGTGGCC ATATGTTTCACCCTGT TTATATTTATGAAGTTAGTGCGGGCT | SEQ ID NO: 3064 | Homo sapiens cAMP responsive element binding protein 3-like 1 (CREB3L1), mRNA [NM_052854] |
| 11 | A_23_P164258 | PIPOX | TGAATCCCCACATAAAGACCAGATGATTGAGTCGTACGTCTTCC TTGGGCGGCTCCGTT | SEQ ID NO: 3065 | Homo sapiens pipecolic acid oxidase (PIPOX), mRNA [NM_016518] |
| 12 | A_23_P164927 | SYNGR4 | CAAAGTCCCCCGGGCTGCTATGATGGCCTGAGAACTAAATATCC TTATCAAATCAATAA | SEQ ID NO: 3066 | Homo sapiens synaptogyrin 4 (SYNGR4), mRNA [NM_012451] |
| 13 | A_23_P18119 | IMPG2 | CGTGATCATAGGACATCACTATTGCCTCCGGTGGTTGGAGTCTTG TCATGTTTTCTGCTAT | SEQ ID NO: 3067 | Homo sapiens interphotoreceptor matrix proteoglycan 2 (IMPG2), mRNA [NM_016247] |
| 14 | A_23_P204144 | KRT85 | CTCGGCTGGGCCTTTTCATGCTAGGGAGAGTGCATCCTAGTTGTC GTCCTGGCAGCTGTT | SEQ ID NO: 3068 | Homo sapiens keratin 85 (KRT85), mRNA [NM_002283] |
| 15 | A_23_P204998 | FARP1 | TCCTCCTGCAACTGCAAGTGGGTTTGAAACTGCGCATTCTCTAGTAGTA TATATGTGCCTGTGT | SEQ ID NO: 3069 | Homo sapiens FERM, RhoGEF (ARHGEF) and pleckstrin domain protein 1 (chondrocyte-derived) (FARP1), transcript variant 1, mRNA [NM_005766] |
| 16 | A_23_P208482 | CLEC4M | CCAACCCACACATCTTCTTGTCCGTATACATGTCTTCGCATTTGG CTGTTTCTGAGTTGTA | SEQ ID NO: 3070 | Homo sapiens C-type lectin domain family 4, member M (CLEC4M), transcript variant 4, mRNA [NM_214677] |
| 17 | A_23_P209389 | CASP8 | GCCCAGCCACCAACCACCTGGGCTAATTTTTTAAAAATATTTTAGTA GAGACAGGGTTTCACT | SEQ ID NO: 3071 | Homo sapiens caspase 8, apoptosis-related cysteine peptidase (CASP8), transcript variant C, mRNA [NM_033356] |
| 18 | A_23_P21495 | FCGBP | TCAGTCATCCACCAGGAACGAAGAATTCCTGAAGAAGACCTGGT CCGTGTGGAGGTTGCG | SEQ ID NO: 3072 | Homo sapiens Fc fragment of IgG binding protein (FCGBP), mRNA [NM_003890] |
| 19 | A_23_P268381 | SPSB4 | CCAACCCACTGCCGCCACCCTTAATGTGAATTGACTGATGAATG AAGAGGGTTTCTAATA | SEQ ID NO: 3073 | Homo sapiens splA/ryanodine receptor domain and SOCS box containing 4 (SPSB4), mRNA [NM_080862] |

Fig. 24-2

| No. | Probe ID No. | Symbols of genes | Sequence | SEQ ID NO: | Descriptions of genes (aliases and numbers within [ ] indicates GenBank accession No.) |
|---|---|---|---|---|---|
| 20 | A_23_P29079 | PFKL | CGACCAGCGCTACGTCTTCGAGGAGGACCGTTTCGAAGATCCGACGACT TAAAGGTCAAGCTGGA | SEQ ID NO: 3074 | Homo sapiens phosphofructokinase, liver (PFKL), transcript variant 1, mRNA [NM_001002021] |
| 21 | A_23_P326212 | ETS1 | GTCAACGCAGCCTATCCAGAAGATCCGGCTATACGCTCGGATTACTT CATTAGGTATGGTATT | SEQ ID NO: 3075 | Homo sapiens v-ets erythroblastosis virus E26 oncogene homolog 1 (avian) (ETS1), mRNA [NM_005238] |
| 22 | A_23_P341938 | NOG | GGCAACGGCTGGGGCTGGATTCCCATCCAGTAGCCCATCATTTCG GAGTGCAAGTGCTCGT | SEQ ID NO: 3076 | Homo sapiens noggin (NOG), mRNA [NM_005450] |
| 23 | A_23_P344531 | SYNPO | TCCTGCTGCTGTGAAGATGAGAAGGTGCTCTTACTCAGTTAATG ATGAGTGACTATATTT | SEQ ID NO: 3077 | Synaptopodin. [Source:Uniprot/SWISSPROT:Acc:Q8N3Y7] [ENST00000307662] |
| 24 | A_23_P34554 | CACNA1E | CCCCCCTCCGATGCATGCTCTTCTCTGCACATGGAGAAAACCAAG ACAGAATTGGGAAGCC | SEQ ID NO: 3078 | Homo sapiens calcium channel, voltage-dependent, R type, alpha 1E subunit (CACNA1E), mRNA [NM_000721] |
| 25 | A_23_P358370 | FOXE1 | CCCCGGGCTACGACCAAGGGCTACGAACCAGCAGGCTTCACCCG GGACCCGTCGGGCCAA | SEQ ID NO: 3079 | H. sapiens HFKH4 mRNA for fork head like protein. [X94553] |
| 26 | A_23_P372144 | C19orf29 | CCCCGGCTCATCTGGAAATAGTTCGGTTGTTCTCTAAAAGA CTTGTAGGTGGGAAAA | SEQ ID NO: 3080 | Homo sapiens chromosome 19 open reading frame 29 (C19orf29), transcript variant 2, mRNA [NM_021231] |
| 27 | A_23_P38265 | LYPD3 | TCCCGTAGTCCCGGCATCTTTGGGGAATCGGTTCCCGATATGTC TTCCTTACTAGAGTGT | SEQ ID NO: 3081 | Homo sapiens LY6/PLAUR domain containing 3 (LYPD3), mRNA [NM_014400] |
| 28 | A_23_P398774 | PLD1 | AGTCTTCCTGGGAATCAATTTTGATTTGGGTGTTGATCTG ATACAGTCTCCCAA | SEQ ID NO: 3082 | Homo sapiens cDNA FLJ34578 fis, clone KIDNE2008404, highly similar to PHOSPHOLIPASE D1 (EC 3.1.4.4). [AK091897] |
| 29 | A_23_P40334 | NPBWR2 | CCTCCCCACGATGGGTGCGAAGGTGTCTCAGGAGACAATGGCACTG GGCACAATGCCACCTT | SEQ ID NO: 3083 | Homo sapiens neuropeptides B/W receptor 2 (NPBWR2), mRNA [NM_005286] |
| 30 | A_23_P407801 | C6orf6 | GTCTCCTAGGTTAGTGTAGGACGAGATTCTATTCTCAGATAAGAC TTCGGTGTGGGCTGAA | SEQ ID NO: 3084 | Homo sapiens mRNA for hypothetical protein (C8orf6 gene). [AJ307469] |
| 31 | A_23_P49310 | ERN2 | CCCACCCCTCTCTTTTTGGAGGACAGCCAAGCAACTCCAGTTCTTC CAGGACGTCAGTGAGT | SEQ ID NO: 3085 | Homo sapiens endoplasmic reticulum to nucleus signalling 2 (ERN2), mRNA [NM_033266] |
| 32 | A_23_P50349 | TRIP10 | CGGAGTTTGATGAGGATTTCGAAGGAGGAGGAAGCGACATCCCCATA GGTCACTGTGTGGCCA | SEQ ID NO: 3086 | Homo sapiens thyroid hormone receptor interactor 10 (TRIP10), mRNA [NM_004240] |
| 33 | A_23_P74668 | C1orf158 | GGTACGTGTCGGCCCTCAAAACCCACAGGTTCCTTCTTTCTTTCCA TCCAACAATTAAAGAT | SEQ ID NO: 3087 | Homo sapiens chromosome 1 open reading frame 158 (C1orf158), mRNA [NM_152290] |
| 34 | A_23_P75867 | OR10A4 | AGTCCTATGTACTTCTTCCTCGAGAAACTTGTCCTTCCTGGAGAT AGGTTTCAAGTTGGTC | SEQ ID NO: 3088 | Homo sapiens olfactory receptor, family 10, subfamily A, member 4 (OR10A4), mRNA [NM_207186] |
| 35 | A_23_P84399 | CNTNAP2 | CTTGAGACATCCTTAAAATATCACCACAAGTTGGGGGAGGGCAG GCAATGGAATATAATG | SEQ ID NO: 3089 | Homo sapiens contactin associated protein-like 2 (CNTNAP2), mRNA [NM_014141] |
| 36 | A_23_P87310 | LMO1 | CCCTCCTGGGGCCAGGCGGGCCTGTACAGATCTGTCTTCTGTAT ATACATGGGAAGATTT | SEQ ID NO: 3090 | Homo sapiens LIM domain only 1 (rhombotin 1) (LMO1), mRNA [NM_002315] |
| 37 | A_24_P102895 | WDTC1 | CTTCCCAGCCCTGTCTTCTAGGTTGGTAATGAAGTATATTTATT GGTGAAGGAAACAGCT | SEQ ID NO: 3091 | Homo sapiens WD and tetratricopeptide repeats 1 (WDTC1), mRNA [NM_015023] |
| 38 | A_24_P108517 | CRB3 | TGGCAACCTGCGTCCGGAAGCCATCACTGCTCTATCATCGTGTCT TCTCCCTCTTGGGTGC | SEQ ID NO: 3092 | Homo sapiens crumbs homolog 3 (Drosophila) (CRB3), transcript variant 3, mRNA [NM_174881] |

Fig. 24-3

| No. | Probe ID No. | Symbols of genes | Sequence | SEQ ID NO: | Descriptions of genes (letters and numbers within [ ] indicates GenBank accession No.) |
|---|---|---|---|---|---|
| 39 | A_24_P117368 | AK055306 | GTGCCTGGGTCGCATTCAAACTCGAGCAGGGGGGGTTGGATCAG GCAGGTTTATTCGAAA | SEQ ID NO: 3093 | Homo sapiens cDNA FLJ30744 fis, clone FEBRA2000378. [AK055306] |
| 40 | A_24_P129107 | NKD2 | CCCCCACCCGCACCCTACGGCCACAAGCGGTACCGCGCAAAAGGG CAGGGAGGGCCACTCG | SEQ ID NO: 3094 | Homo sapiens naked cuticle homolog 2 (Drosophila) (NKD2), mRNA [NM_033120] |
| 41 | A_24_P150428 | FAM124A | CGTCCGTGGCCTCGTCAGCTGAAACACACAGTGGTTTCAAACACA GGTGCCCCAGGGGACA | SEQ ID NO: 3095 | Homo sapiens family with sequence similarity 124A (FAM124A), mRNA [NM_145019] |
| 42 | A_24_P15182 | LOC646960 | GCCAGGACCCTGCCGGAACCGGCCTGCGGCCATCGCGGGCTGG GGGCGGCTCTTCGGAAG | SEQ ID NO: 3096 | PREDICTED: Homo sapiens similar to transmembrane protease, serine 9 (LOC646960), mRNA [XM_929928] |
| 43 | A_24_P15797 | NUDT22 | CCGGCGCTCACATTCATTGGCGTGGATGCCAAGACACAGTCC ACCTGTCAGGAAAAAA | SEQ ID NO: 3097 | Homo sapiens cDNA FLJ34477 fis, clone HLUNG2003833. [AK091796] |
| 44 | A_24_P161144 | MGC46336 | CCTCCGTCGACAGAGACCCGGCTCAGGACGCGCTTTCTGTATGGC AGATCTTTCTCAGAAG | SEQ ID NO: 3098 | Homo sapiens hypothetical protein MGC46336, mRNA (cDNA clone MGC:46336 IMAGE:5589928), complete cds. [BC036762] |
| 45 | A_24_P161681 | LOC729956 | TCTCGGATCGTGCCCGGTCCTACGAGGGCTGCGGTGAAATCCGAG CTGAACCGCTACTCTT | SEQ ID NO: 3099 | PREDICTED: Homo sapiens hypothetical protein LOC729956 (LOC729956), mRNA [XM_001131873] |
| 46 | A_24_P166434 | PSORS1C2 | CCTACCCGGCCCCAGTCGTCCCTGGAGAGACCTGCCTGAAACTGG AGTGTGGCCCCTGAA | SEQ ID NO: 3100 | Homo sapiens psoriasis susceptibility 1 candidate 2 (PSORS1C2), mRNA [NM_014069] |
| 47 | A_24_P178877 | LOC339809 | TGCGCCCACCCCGCCAGCATGGCTTGGAAGAGTGAAAGGCATAGAG GGATTCTTTTGCTGCA | SEQ ID NO: 3101 | Homo sapiens mRNA for KIAA2012 protein. [AB095932] |
| 48 | A_24_P20795 | IRX4 | CCCTTCCGCACTCGCGCGCCCTGGACAGGACCACCACTCCCCG GTAAGCAGTCTGTCAGAA | SEQ ID NO: 3102 | Homo sapiens iroquois homeobox protein 4 (IRX4), mRNA [NM_016358] |
| 49 | A_24_P209339 | MLXIPL | CCAGCCCGCTTCCCATAGAGCTTCTACCCTTGGGGTATTGGGAG CCTGGCTTTGGGCCTT | SEQ ID NO: 3103 | Homo sapiens MLX interacting protein-like (MLXIPL), transcript variant 4, mRNA [NM_032954] |
| 50 | A_24_P218074 | ZNF467 | GGATGCCCCGGCGGCCAAAGCGCCTGGCCAGCGCGCTGGCGGAC CAGGCTGCGGGCCAGG | SEQ ID NO: 3104 | Homo sapiens zinc finger protein 467 (ZNF467), mRNA [NM_207336] |
| 51 | A_24_P252223 | C6orf85 | ACACCCTCGTTCCGCTACCTAGCCTCGTCCAGGCTTTCAATAA AAGTTATGCAGAAATG | SEQ ID NO: 3105 | Homo sapiens chromosome 6 open reading frame 85 (C6orf85), mRNA [NM_021945] |
| 52 | A_24_P254133 | APC2 | TGTGCCCAGGGCCATGGTCGTCGGCAGCCACCACCGAGTCCGGCCG CGGAGAAAGCCGCGGC | SEQ ID NO: 3106 | Homo sapiens adenomatosis polyposis coli 2 (APC2), mRNA [NM_005883] |
| 53 | A_24_P272845 | DOCK3 | GCCGGCATTCATGACTGTCGTCGTCTCCAGTGCCTCACATGCGTCAGTGAA GCAGGAAACAACTGGTGA | SEQ ID NO: 3107 | Homo sapiens dedicator of cytokinesis 3 (DOCK3), mRNA [NM_004947] |
| 54 | A_24_P280497 | KIAA1545 | CATCCCCGGCTCCCGGCAGAGGAAGCGCGGGCCCTGGAGAGACGGTGAAGGTC AAGGAGGAGGCGCGG | SEQ ID NO: 3108 | Homo sapiens XTP9 (XTP9) mRNA, complete cds. [AF490258] |
| 55 | A_24_P306034 | ANKDD1A | CTCTCTCCCGGTTGTACTCATCAATTCTGCCAGTAAAATTCTC CTCTATGACCTGAAA | SEQ ID NO: 3109 | Homo sapiens cDNA FLJ25870 fis, clone CBR02141. [AK098736] |
| 56 | A_24_P315066 | ZMIZ2 | CACGCGGACCTCCTACGAACAACATGACGACCTGGTTTCTCTG TTTGAGACAACTGAT | SEQ ID NO: 3110 | Homo sapiens zinc finger, MIZ-type containing 2 (ZMIZ2), transcript variant 1, mRNA [NM_031449] |
| 57 | A_24_P316454 | BC022826 | AGAACACAGAGGGCGGGCCCCACCGAATCAAGGTCATTGGTCTT CAAGATAAAGTGCCTA | SEQ ID NO: 3111 | Homo sapiens cDNA clone IMAGE:5441030, partial cds. [BC022826] |
| 58 | A_24_P331711 | THEM5 | TATCACGGCTCGTCCCACACCACCCTGGCTTCATCATGAGTGC AGTGTCATGTCAGCGG | SEQ ID NO: 3112 | Homo sapiens thioesterase superfamily member 5 (THEM5), mRNA [NM_182578] |
| 59 | A_24_P345637 | MSX1 | ACCGCGCGGCCAAGGCAAAGAGACTACAAGAGGCAGAATGGGAG AAGGTCGAAGATGGCGCG | SEQ ID NO: 3113 | Homo sapiens msh homeobox 1 (MSX1), mRNA [NM_002448] |

Fig. 24-4

| No. | Probe ID No. | Symbols of genes | Sequence | SEQ ID NO: | Descriptions of genes (letters and numbers within [ ] indicate GenBank accession No.) |
|---|---|---|---|---|---|
| 60 | A_24_P348885 | CYB561D1 | CCTCCCTGCTCTCAAACTCTCCAGTGTGGTGTGAAACTCAGAAGAAACGGTTACTGGGGCT | SEQ ID NO: 3114 | Homo sapiens cytochrome b-561 domain containing 1 (CYB561D1), mRNA [NM_182580] |
| 61 | A_24_P349274 | OR4X2 | GGAGGGCTTGATGCATTCCTTTGCACAAATCCTTCTCCATCTTCCACCTGCTCTTCTGTGG | SEQ ID NO: 3115 | Homo sapiens olfactory receptor, family 4, subfamily X, member 2 (OR4X2), mRNA [NM_001004727] |
| 62 | A_24_P366122 | ACBD4 | TACCGCCCCTCCTATGAAGAGATGCTGGGATTCCTACAGTTACTACAAGCAGGGCACCATG | SEQ ID NO: 3116 | Homo sapiens acyl-Coenzyme A binding domain containing 4 (ACBD4), mRNA [NM_024722] |
| 63 | A_24_P385012 | BC030084 | TCCCCCCTCATGTGTTGGGTCAAATACTGCTTTATCCTTTAGTACTAAAATTAAAAGTTAC | SEQ ID NO: 3117 | Homo sapiens cDNA clone IMAGE:4791887. [BC030084] |
| 64 | A_24_P39484 | AK025430 | CGGAGCTCGGGCACCGGTCACGGAGTCGCGGGCGGCGGCGGCGACCGGACACGGGCCAAATGCCGGG | SEQ ID NO: 3118 | Homo sapiens cDNA: FLJ21777 fis, clone HEP00173. [AK025430] |
| 65 | A_24_P401270 | LOC649294 | TCCTCTCCTCCAGCTCTCCCCACATGAAATAATTCTGATAACGACACATGGAGTTTG | SEQ ID NO: 3119 | Homo sapiens cDNA FLJ33940 fis, clone CTONG2018069. [AK091259] |
| 66 | A_24_P401294 | FLJ35934 | CCCAGCCCCTTCTCGCGCGTCTCCAACTGCCTTTCACCTAGAAGCGCTCAGCAGCGTGCGCC | SEQ ID NO: 3120 | Homo sapiens cDNA FLJ35934 fis, clone TEST12011315. [AK093253] |
| 67 | A_24_P405892 | SYNPO | CCTCCCCAGCCAAGCCCAGGCTCCGTTGGACCTGGTGCCAACCTGCCCAAGGGGGCTCCCC | SEQ ID NO: 3121 | Homo sapiens synaptopodin (SYNPO), mRNA [NM_007286] |
| 68 | A_24_P419028 | MCP-1 | ACCCCCTCACTTTTCAGACCTATAGTTGTCCTTTTGATTCTCCAGTTAAAACTACAA | SEQ ID NO: 3122 | Homo sapiens mRNA for MCP-1, complete cds. [AB014711] |
| 69 | A_24_P478362 | NP511100 | ATCGACCCCGGCCCGGAAGAGAACCACTGCGATGCGGGGGCTCAACGCCAGGCAGGCAATCCTAG | SEQ ID NO: 3123 | GB_AB065467.1 [BAC35726.1 seven transmembrane helix receptor [Homo sapiens]. [NP511100] |
| 70 | A_24_P542291 | LOC339352 | CACTTCCGCGGCCTCCGACTACTTCTCAGAGAGAGGAGGCGCCGGGAACCTGCAAGCGC | SEQ ID NO: 3124 | PREDICTED: Homo sapiens similar to ATP binding domain 3 (LOC339352), mRNA [XR_017668] |
| 71 | A_24_P662177 | THC2666469 | GGGGAGGTAGGATTTGAATTGCATGTTACATAACCATCGTCTAAAGGGACAGAATGTACA | SEQ ID NO: 3125 | |
| 72 | A_24_P689119 | A_24_P689119 | CCGCCTCCCCACAACACCCAAAGACACCAGAACCCAGGTCCTCCACTGCATCCCGGACGCCTC | SEQ ID NO: 3126 | |
| 73 | A_24_P752279 | A_24_P752279 | GCCCCACCCTCTCGAGACAGGCACCAGGCTGTGGTGACCGGCTCTCAGCAGTCCTCCT | SEQ ID NO: 3127 | |
| 74 | A_24_P778928 | A_24_P778928 | TCCAGGCCGGCGCACCTGCCATCGGCAAGAGCCGGCTCAGACAAAGACCCCGC | SEQ ID NO: 3128 | |
| 75 | A_24_P828125 | A_24_P828125 | CAGTCCCACCCGCACCAGCAGCAGCAAAGTCAGCGCCAGGATTGACACCCAGCAGTGGGGGC | SEQ ID NO: 3129 | |
| 76 | A_24_P848662 | CR594528 | CTGCGCTGCCGCGACGCACGACGCCATCGTCAAGAAATGAGGACTGAGGACTGCGCAGCAGGCGGC | SEQ ID NO: 3130 | full-length cDNA clone CS0DM002YC17 of Fetal liver of Homo sapiens (human). [CR594528] |
| 77 | A_24_P916317 | FOXC1 | CAGAAGCCCGGACAAGAAGATCAGCGCTGAATGGGATTTACCAGTTCATCATGGAGCGGC | SEQ ID NO: 3131 | Homo sapiens FOXC4a mRNA, partial cds. [AF343007] |
| 78 | A_24_P929524 | THC2534212 | TCCTGGACCTATTATGGCCTCCATCTCTTCCTGGGGAAGGTCGAGGTTGGCTGGCTCTCA | SEQ ID NO: 3132 | 060448_HUMAN (060448) Neuronal thread protein AD7c-NTP, partial (15%) [THC2534212] |
| 79 | A_24_P930963 | LOC650392 | GCCCCATTTGAAGTATAACCAGGAGGGGAAAATGGTCCTTGAAATAAGGACATGCCAGAAGG | SEQ ID NO: 3133 | Homo sapiens cDNA clone IMAGE:5264670. [BC036550] |
| 80 | A_32_P101073 | A_32_P101073 | GCCCGGCCCGACGTGCGCGACACCTGGTACGACGGGGACGTCACCGAGGTGGAGGAGCCC | SEQ ID NO: 3134 | |

Fig. 24-5

| No. | Probe ID No. | Symbols of genes | Sequence | SEQ ID NO: | Descriptions of genes (letters and numbers within [ ] indicates GenBank accession No.) |
|---|---|---|---|---|---|
| 81 | A_32_P125589 | THC2649341 | CGCTCTATCCCTTGCTTTAGGCTTTTGAATGAAAGTGAGATGTCTCATCAGCTCAGATAG | SEQ ID NO: 3135 | |
| 82 | A_32_P132356 | THC2635710 | GTGTTTTTCCCCCTCCAGAATCTAAGACGCGATAGGGTTTCTCCAAATAAACGGGCAAT | SEQ ID NO: 3136 | |
| 83 | A_32_P136622 | BC020341 | CCCAGCCCGAAGAGGTGCTCGACCTTCAGATACTGGGCAGCCCTCTGCACGCTCCAGCCG | SEQ ID NO: 3137 | Homo sapiens cDNA clone IMAGE:4177218, [BC020341] |
| 84 | A_32_P142802 | THC2699446 | CCGCCGCAACCACATCCGAAGAAAGGGGTCAGGTATTCTAGGCGTACGGGGACTGATAAA | SEQ ID NO: 3138 | |
| 85 | A_32_P145784 | BC043547 | GGTCCCGTCCCTCTCTGTAACCAATAACCAATGCCATATAATGGAAAAGTATAAGCAA | SEQ ID NO: 3139 | Homo sapiens, clone IMAGE:5171873, mRNA. [BC043547] |
| 86 | A_32_P156776 | THC2503530 | CCCCCCTTTTTTCCTTAAGCATAATTGTCTTAGGTTTGCCTAGTTTGATTTTAAGAA | SEQ ID NO: 3140 | AA360388 EST169518 T-cell lymphoma Homo sapiens cDNA 5' end similar to EST containing Alu repeat, mRNA sequence [AA360388] |
| 87 | A_32_P16662 | THC2567600 | TGGGTGGTCTGGGCTAAATGATCAAGTGAAACAGAAAGCCAGGAAGGATCTGTGCTAATT | SEQ ID NO: 3141 | F10881 HSC3LC012 normalized infant brain cDNA Homo sapiens cDNA clone c-3lc01 3', mRNA sequence [F10881] |
| 88 | A_32_P172002 | A_32_P172002 | GGGACCGAGGTCTCTCTCTCTCTCTTTCATTCATTTATTCAAAACTATGCATCCAGGGC | SEQ ID NO: 3142 | |
| 89 | A_32_P199506 | BU191598 | GATCCTCTGAGGTTTTGCAGGAAGACCCCGGCCTAATCTCTGAAGGTCGGAGGTCACAG | SEQ ID NO: 3143 | AGENCOURT_8099541 NIH_MGC_102 Homo sapiens cDNA clone IMAGE:6254414 5', mRNA sequence [BU191598] |
| 90 | A_32_P213509 | THC2663555 | GATTGTTCAGTGTTGGAGGGGTTTTTAATGAAAATTCAACACCTACACTGGAAAA | SEQ ID NO: 3144 | |
| 91 | A_32_P29130 | BG058000 | CCCAGCCAACGGTGTTTGTTAAGGAACTAAAACATTACATCTGGTGAACAGCAAAGATTTCA | SEQ ID NO: 3145 | BG058000 7f78d09.x1 Lupski_dorsal_root_ganglion Homo sapiens cDNA clone IMAGE:3303208 3', mRNA sequence [BG058000] |
| 92 | A_32_P34325 | RIMBP2 | ACGGAGAGCGTGCACCCCAATCAAAGCCATTAGCAGCAAGTTCTGGAGTCCCCGAAACCAAAG | SEQ ID NO: 3146 | Homo sapiens RIMS binding protein 2 (RIMBP2), mRNA [NM_015347] |
| 93 | A_32_P37943 | A_32_P37943 | CCGCCGCGGACCCCCGTCTGGCAGTCCCCAGCCGCGTGGGGCTCGGCTGTGGGGCGGGGTC | SEQ ID NO: 3147 | |
| 94 | A_32_P4466 | FLJ32214 | AACCCCCCTGTGGCAAACCTCTACACTTGGATTAATAACATCCAACATAGCGGAATG | SEQ ID NO: 3148 | Homo sapiens FLJ32214 protein, mRNA (cDNA clone IMAGE:40024597), complete cds. [BC104018] |
| 95 | A_32_P74615 | SP5 | GCCCCCGCATCCCAGCTTGGGGCTGACGCCGGAGAGAGAGCCACCTGCAGCCGTCGTTCGG | SEQ ID NO: 3149 | Homo sapiens Sp5 transcription factor (SP5), mRNA [NM_001003845] |
| 96 | A_32_P76566 | THC2608192 | CTTCCCGTGTGCGGCGCGCCGCTGTACTGTCTTCACACTCGCCATCACGTTGCACACGGTGC | SEQ ID NO: 3150 | Q7XQ69_ORYSA (Q7XQ69) Expressed protein, partial (6%) [THC2689192] |
| 97 | A_32_P79103 | BM932034 | GTGCTACAGAATGAAAATAGCATTTTAGGAAGGTTGAGTCAGAGGTGCGAGTGGGGCATA | SEQ ID NO: 3151 | UI-E-EJ1-aji-k-24-0-UI.r1 UI-E-EJ1 Homo sapiens cDNA clone UI-E-EJ1-aji-k-24-0-UI 5', mRNA sequence [BM932034] |
| 98 | A_32_P82111 | LRFN2 | ATGGGGACTGAGCCGCTGAGTGTTTGGAAAGGCAGAGGACTCCGCCTTTCTAATCACAAATG | SEQ ID NO: 3152 | Homo sapiens leucine rich repeat and fibronectin type III domain containing 2 (LRFN2), mRNA [NM_020737] |

Fig. 24-6

| No. | Probe ID No. | Symbols of genes | Sequence | SEQ ID NO: | Descriptions of genes (letters and numbers within [ ] indicates GenBank accession No.) |
|---|---|---|---|---|---|
| 99 | A_23_P102235 | SNRPG | ACAACAGAACAATATTGGAATGTGGTAATACGAGGGAAATAGTATCATCATGTTAGAAGC | SEQ ID NO: 3153 | Homo sapiens small nuclear ribonucleoprotein polypeptide G (SNRPG), mRNA [NM_003096] |
| 100 | A_23_P108394 | THC2783023 | ATTCAGAAAGTTGCTGTGTGTGATAGATAGTAAGTCTGTTGATTTATTAGTTGGTTGTGTG | SEQ ID NO: 3154 | Q8IUM9_HUMAN (Q8IUM9) ACSL3 protein, complete [THC2467888] |
| 101 | A_23_P110362 | MAP2K1IP1 | ACTGAGACAAGTTGTGGAAGTTCTTAATCTGACAGTGGTTCAGTGTGTACCTTATCTT | SEQ ID NO: 3155 | Homo sapiens mitogen-activated protein kinase kinase 1 interacting protein 1 (MAP2K1IP1), mRNA [NM_021970] |
| 102 | A_23_P110611 | ZH2C2 | CTCTTGAAAAGCAGAACTTTCAGTCTGTCTGTTGGACTTCTTCAAAACCAGGTTCTGAATACTTAA | SEQ ID NO: 3156 | Homo sapiens zinc finger, H2C2 domain containing (ZH2C2), mRNA [NM_017676] |
| 103 | A_23_P111321 | ARG1 | TGGAATCACGAGACAAAGCTACCACAGTGTGGAAAGGTAGTATGTGTCGATGTCATTCAAA | SEQ ID NO: 3157 | Homo sapiens arginase, liver (ARG1), mRNA [NM_000045] |
| 104 | A_23_P11201 | GPR34 | AGTAGGAGTGAAAGCACTTCAGAATTTAAACCAGGATAGTCCCTGCATGATGATCATCTGTG | SEQ ID NO: 3158 | Homo sapiens G protein-coupled receptor 34 (GPR34), transcript variant 1, mRNA [NM_005300] |
| 105 | A_23_P112251 | LOC552891 | AGAATTCTTAACTTCACAAGTTGTTTTAGTTCGACGATGTGCCTTTGATTTAATTGGGAC | SEQ ID NO: 3159 | Homo sapiens hypothetical protein LOC552891 (LOC552891), mRNA [NM_004125] |
| 106 | A_23_P117852 | KIAA0101 | TACTGCTGCATTTTTATTGGTGTTTGATTATGGAATGGTGCCATATGTCACTCGTTG | SEQ ID NO: 3160 | Homo sapiens KIAA0101 (KIAA0101), transcript variant 1, mRNA [NM_014736] |
| 107 | A_23_P120048 | BAZ2B | TATTTTCGTCTGAAGGTAATGATAGCTATACAGTCTGTACAGTAATTATCCTGTACGAAC | SEQ ID NO: 3161 | Homo sapiens bromodomain adjacent to zinc finger domain, 2B (BAZ2B), mRNA [NM_013450] |
| 108 | A_23_P120316 | MTHFD2 | AGGATATATCGTTGCTATTAGTACTCATTTTATGTATGTTACCCTTCAGTAAGTTCTCCC | SEQ ID NO: 3162 | Homo sapiens methylenetetrahydrofolate dehydrogenase (NADP+ dependent) 2, methenyltetrahydrofolate cyclohydrolase (MTHFD2), nuclear gene encoding mitochondrial protein, transcript variant 1, mRNA [NM_006636] |
| 109 | A_23_P121622 | SULT1B1 | GAAATAGAGATTGTCTGTAGTTGATTGAAACGAGGGCAGTTATGAATTGATTTGGGGAAT | SEQ ID NO: 3163 | Homo sapiens mRNA for ST1B2, complete cds. [D89479] |
| 110 | A_23_P121716 | ANXA3 | TGGACATTCGAACAGAGTTCAAGAAGCATTATGGCTATTCCCTATATTCAGGAATTAAAT | SEQ ID NO: 3164 | Homo sapiens annexin A3 (ANXA3), mRNA [NM_005139] |
| 111 | A_23_P128930 | PSMC6 | GAACAAGCAAGATTAGACATACTGAAAATCCATGCAGGTCCCATTACAAACCATGGTGAA | SEQ ID NO: 3165 | Homo sapiens proteasome (prosome, macropain) 26S subunit, ATPase, 6 (PSMC6), mRNA [NM_002806] |
| 112 | A_23_P134714 | HRSP12 | TAAATTACAGCGTGTGTGACCTGTGTATTACTGAATATAGGAAGAGATACGCATTAGATAG | SEQ ID NO: 3166 | Homo sapiens heat-responsive protein 12 (HRSP12), mRNA [NM_005836] |
| 113 | A_23_P137366 | C1QB | CACCGACACAGAACTCACTACTGGGCGATGGAGGTGCCAACAGCATCTTTTCCGGGTTCCT | SEQ ID NO: 3167 | Homo sapiens complement component 1, q subcomponent, B chain (C1QB), mRNA [NM_000491] |
| 114 | A_23_P141549 | RPS7 | GTGAAACTAGATCAGCAGGGCGGGTCATAAAGGTTCATTTGGACGAAGCAGGAACGAAT | SEQ ID NO: 3168 | Homo sapiens ribosomal protein S7 (RPS7), mRNA [NM_001011] |
| 115 | A_23_P143858 | RPL22L1 | ATTGGCTTCGAGTGGTTGCATCGTGGACAAGGAGACCTACGAAGTTCGTTACTTCCAGATTA | SEQ ID NO: 3169 | Homo sapiens ribosomal protein L22-like 1, mRNA (cDNA clone IMAGE:4865966), [BC049823] |
| 116 | A_23_P144497 | RPS3A | CCAAATCCGACGAAGAATGATGGAAATCATGACCCGAGAGTGCAGACAAATGACTTGAA | SEQ ID NO: 3170 | Homo sapiens ribosomal protein S3A (RPS3A), mRNA [NM_001006] |
| 117 | A_23_P14564 | GPR65 | AACAAGTTAAATTGTTGCTGATCGAATTCTGTAGTGTTTGTAACCGAAACAGGAAG | SEQ ID NO: 3171 | Homo sapiens G protein-coupled receptor 65 (GPR65), mRNA [NM_003608] |

Fig. 24-7

| No. | Probe ID No. | Symbols of genes | Sequence | SEQ ID NO: | Descriptions of genes (letters and numbers within [ ] indicates GenBank accession No.) |
|---|---|---|---|---|---|
| 118 | A_23_P14708 | SUHW4 | TCTTTGTACGTCCATACAAGTGTTAGGCTGCCAGGCTGTAAGCTTACCTTAATTAAACTT | SEQ ID NO: 3172 | Homo sapiens suppressor of hairy wing homolog 4 (Drosophila) (SUHW4), transcript variant 1, mRNA [NM_017661] |
| 119 | A_23_P14734 | RPS27L | TACAAGATCACCACGGTTTTCAGCCATGCTCAGACAGTGGTTCTTTGTGTAGGTTGTTCA | SEQ ID NO: 3173 | Homo sapiens ribosomal protein S27-like (RPS27L), mRNA [NM_015920] |
| 120 | A_23_P151637 | RNASE2 | GTGGTAACGCAAATATGACCTGTCCTAGTAACAAAACTCGGAAAAATTGTCACCACAGTG | SEQ ID NO: 3174 | Homo sapiens ribonuclease, RNase A family, 2 (liver, eosinophil-derived neurotoxin) (RNASE2), mRNA [NM_002934] |
| 121 | A_23_P152002 | BCL2A1 | TGTAACCATATTTGCATTTGAAGGTATTCTGATCAAGAAACTTCTACGACAGCAAATTGC | SEQ ID NO: 3175 | Homo sapiens BCL2-related protein A1 (BCL2A1), mRNA [NM_004049] |
| 122 | A_23_P153037 | ZNF624 | TGTCGTTAGATGCAGATGGAGGACAGGTATGGAAGAATATACACCAGGCTGTTAATATTGA | SEQ ID NO: 3176 | Homo sapiens zinc finger protein 624 (ZNF624), mRNA [NM_020787] |
| 123 | A_23_P155765 | HMGB2 | TAAAAATGCAGGTTGTAGGTTTTTGATGGGCTACTCATACAGTTAGATTTACAGGTTC | SEQ ID NO: 3177 | Homo sapiens high-mobility group box 2 (HMGB2), mRNA [NM_002129] |
| 124 | A_23_P155815 | NCAPG | AAGTTAGGAAAGACGAATGGAGGTGGAATCCTTTAAGATTATGTCCAGTTATTTGGTTTAA | SEQ ID NO: 3178 | Homo sapiens non-SMC condensin I complex, subunit G (NCAPG), mRNA [NM_022346] |
| 125 | A_23_P165842 | EEF1E1 | AAGAAAAAGGAATCGTTCAGCAGTGGTTAGAATACAGAGGGTCACTCAAGTGATGGGCACT | SEQ ID NO: 3179 | Homo sapiens eukaryotic translation elongation factor 1 epsilon 1 (EEF1E1), mRNA [NM_004280] |
| 126 | A_23_P157449 | POLR2K | GGTCTCTCTTGCTTCAAATATCTCTTGTACAGTACTCACCATTTTAGATGGTTGGAC | SEQ ID NO: 3180 | Homo sapiens polymerase (RNA) II (DNA directed) polypeptide K, 7.0kDa (POLR2K), mRNA [NM_005034] |
| 127 | A_23_P159950 | COX7B | CAAATACGGTAATGCTGTATTAGCTAGTGGAGCCACTTCTGTATTGTTACATGGACAATA | SEQ ID NO: 3181 | Homo sapiens cytochrome c oxidase subunit VIIb (COX7B), nuclear gene encoding mitochondrial protein, mRNA [NM_001866] |
| 128 | A_23_P160466 | SLC19A2 | CTTGGTATGTGGGCATATTTATAGAATGCTGAACTCAATGTGCAAGTGTACTGTATGCA | SEQ ID NO: 3182 | Homo sapiens solute carrier family 19 (thiamine transporter), member 2 (SLC19A2), mRNA [NM_006996] |
| 129 | A_23_P162596 | ACTR6 | TTAACGGCTCACTGGACAGAGTTTTCCTTAGAAGGTAGTTTTGTGTGACTGTGACTAAACT | SEQ ID NO: 3183 | Homo sapiens ARP6 actin-related protein 6 homolog (yeast) (ACTR6), mRNA [NM_022496] |
| 130 | A_23_P163225 | RNASE3 | AGCCACAGCCTCAGAGACTGGGAAACATGGTTCCAAAACTGTTCAGTCCCAAATTTGTCT | SEQ ID NO: 3184 | Homo sapiens ribonuclease, RNase A family, 3 (eosinophil cationic protein) (RNASE3), mRNA [NM_002935] |
| 131 | A_23_P167168 | IGJ | TTGGGTGATGTAAAACCAACTGCGTGCGACCACCAAAATAATTAAAATAGTCACATTGTTATC | SEQ ID NO: 3185 | Homo sapiens immunoglobulin J polypeptide, linker protein for immunoglobulin alpha and mu polypeptides (IGJ), mRNA [NM_144646] |
| 132 | A_23_P170233 | CSTA | AACTGGGTAGTGAGTCATGATCGTTGCTGCTGATAAATATAACCATCAATAAAGAAGCATTCT | SEQ ID NO: 3186 | Homo sapiens cystatin A (stefin A) (CSTA), mRNA [NM_005213] |
| 133 | A_23_P18325 | PDCD10 | CCAACCGACTAATTCATCAAACCAACTTAATACTTCAGACCTTCAAAACTGTGCCTGAA | SEQ ID NO: 3187 | Homo sapiens programmed cell death 10 (PDCD10), transcript variant 1, mRNA [NM_007217] |
| 134 | A_23_P18372 | B3GNT5 | AAATGTCAACAAAGGGAAAATAAACTATCAGCTTGGATGGTCACTTGAATAGAAGAATGGT | SEQ ID NO: 3188 | Homo sapiens UDP-GlcNAc:betaGal beta-1,3-N-acetylglucosaminyltransferase 5 (B3GNT5), mRNA [NM_032047] |
| 135 | A_23_P18291 | TUBB2A | AGTTCTCAGATCAATCAATGCATCCTTAGTGAACTTCTGTTGTGCTCAAGGCATGGTCTTTC | SEQ ID NO: 3189 | Homo sapiens tubulin, beta 2A (TUBB2A), mRNA [NM_001069] |

Fig. 24-8

| No. | Probe ID No. | Symbols of genes | Sequence | SEQ ID NO: | Descriptions of genes (letters and numbers within [ ] indicates GenBank accession No.) |
|---|---|---|---|---|---|
| 136 | A_23_P200030 | FPGT | TAAAAATTGGTAAACTAGAAGTAACTTGTCACAACCCTCAGTTATGATACTTATGTGCG | SEQ ID NO: 3190 | Homo sapiens fucose-1-phosphate guanylyltransferase (FPGT), mRNA [NM_003838] |
| 137 | A_23_P200228 | AGL | TAGATTTTAACAGGTGTCATTTGACTCATTGACTAAACGTTTCGGTAGAATGCTTCATACTTGAGTG | SEQ ID NO: 3191 | Homo sapiens amylo-1, 6-glucosidase, 4-alpha-glucanotransferase (glycogen debranching enzyme, glycogen storage disease type III) (AGL), transcript variant 4, mRNA [NM_000028] |
| 138 | A_23_P200955 | A_23_P200955 | AGAACATGATTGAACCTCACATTGATGTCAAGACTACCGATGGTTATTTGTTTCATCTAC | SEQ ID NO: 3192 | |
| 139 | A_23_P20225 | RRM2B | TGCTCCTTTGTAAAAAGTTAAAGATTTGAAAGAGAATCTCATATTGCCGAGGGCATTAGGA | SEQ ID NO: 3193 | Homo sapiens ribonucleotide reductase M2 B (TP53 inducible) (RRM2B), mRNA [NM_015713] |
| 140 | A_23_P204289 | USP15 | GACCAGGATAAATGAGGTATGTTGATGATGGCTTTGTTTATATCTTGATATTAAAGCTG | SEQ ID NO: 3194 | Homo sapiens ubiquitin specific peptidase 15 (USP15), mRNA [NM_006313] |
| 141 | A_23_P205336 | C14orf129 | CAATTCATTGCCAGACTTCATTGGAATGCTTTCGTTGTTGATGATGTATGTTCATTCTCAGCT | SEQ ID NO: 3195 | Homo sapiens chromosome 14 open reading frame 129 (C14orf129), mRNA [NM_016472] |
| 142 | A_23_P207299 | LOC51136 | CCAAACACGAATTTGAAATTAGAAGTAGTGGTTTTAGAGAAGTCAGGTATTCGTTCCTG | SEQ ID NO: 3196 | Homo sapiens PTD016 protein (LOC51136), mRNA [NM_016125] |
| 143 | A_23_P210274 | PREI3 | GGATACAGTATGCCGTAGGATTTACAGAATATTTTCACATGGCTATTTCATCATCGGCAG | SEQ ID NO: 3197 | Homo sapiens preimplantation protein 3 (PREI3), transcript variant 1, mRNA [NM_015387] |
| 144 | A_23_P2129 | TMEM126B | CATATGCATCATTGGCTACACTGGCATTCTTTTGTCTACTGTTGTTACTGACAAGCTTTTG | SEQ ID NO: 3198 | Homo sapiens transmembrane protein 126B (TMEM126B), mRNA [NM_018480] |
| 145 | A_23_P213561 | HISPPD1 | GTATGTAAGTTTTCTGTTTGTGAAAATGTAGTAATGTAGTCACGTGTGGGAGGTCATAAGG | SEQ ID NO: 3199 | Homo sapiens histidine acid phosphatase domain containing 1 (HISPPD1), mRNA [NM_015216] |
| 146 | A_23_P215751 | NDUFA5 | TAAAAGTGGAGTCAGTCAGTAAATAGTTGCAGTACACGTTTCTAATATAAGTGTAGGTGGGTATC | SEQ ID NO: 3200 | Homo sapiens NADH dehydrogenase (ubiquinone) 1 alpha subcomplex, 5, 13kDa (NDUFA5), nuclear gene encoding mitochondrial protein, mRNA [NM_005000] |
| 147 | A_23_P217319 | FGF13 | TTGCATGGAAGAAAGTTGGGTTGTTGGCATAGAGATTGCATGATATGTAAGATTTTGTGCA | SEQ ID NO: 3201 | Homo sapiens fibroblast growth factor 13 (FGF13), transcript variant 1A, mRNA [NM_004114] |
| 148 | A_23_P218926 | C4orf18 | CAGATGAGTTCCTTCTCTGTAGATGTGTTTTCAGAGGTAGGTACAGAGGAATGTTTG | SEQ ID NO: 3202 | Homo sapiens chromosome 4 open reading frame 18 (C4orf18), transcript variant 2, mRNA [NM_016613] |
| 149 | A_23_P260002 | HACE1 | TAAGCAGTCATTGTGTTGTTTGGCAGTAATGTTGAGAGACATGTAAGTTGAAAGTTTGCTA | SEQ ID NO: 3203 | Homo sapiens HECT domain and ankyrin repeat containing, E3 ubiquitin protein ligase 1 (HACE1), mRNA [NM_020771] |
| 150 | A_23_P251937 | CPEB4 | GTATGTCAGTTAATTGTACTACTTGGCTGAATTTCGATATAGTTTTTACTGTGTATGGGG | SEQ ID NO: 3204 | Homo sapiens cytoplasmic polyadenylation element binding protein 4 (CPEB4), mRNA [NM_030627] |
| 151 | A_23_P252201 | EAF2 | CACGATTCCTGATATAGATGCCAGTCATCATAATAGATTTCGAGACAACAGTGGCGTCTGAT | SEQ ID NO: 3205 | Homo sapiens ELL associated factor 2 (EAF2), mRNA [NM_018456] |
| 152 | A_23_P25235 | CLEC4D | CATTTAACGCCACGACGAGTATTCTGGCATAAGAATGAACCCGACAACTCTCAGGGACAAA | SEQ ID NO: 3206 | Homo sapiens C-type lectin domain family 4, member D (CLEC4D), mRNA [NM_080387] |
| 153 | A_23_P252371 | RBBP8 | GGGAAGGAAGCAGAAGAGACATAGACGTTGAAACAGAAACAGAAGAAGATGAAGGACAAGTTTTTT | SEQ ID NO: 3207 | Homo sapiens retinoblastoma binding protein 8 (RBBP8), transcript variant 1, mRNA [NM_002894] |
| 154 | A_23_P26021 | COPS2 | TGCTTTTTTGATCAACTGCTTTGTGTTTGTGTGCTGCATTTATCCCAAGGAAAAACAGCTT | SEQ ID NO: 3208 | Homo sapiens COP9 constitutive photomorphogenic homolog subunit 2 (Arabidopsis) (COPS2), mRNA [NM_004236] |

Fig. 24-9

| No. | Probe ID No. | Symbols of genes | Sequence | SEQ ID NO: | Descriptions of genes (letters and numbers within [ ] indicates GenBank accession No.) |
|---|---|---|---|---|---|
| 155 | A_23_P2705 | P2RY5 | TCTGTATTGCTGTTTCGAACTGTTGTTTTGAGCCCTATAGTTTAC TACTTTACATCGGACA | SEQ ID NO: 3209 | Homo sapiens purinergic receptor P2Y, G-protein coupled, 5 (P2RY5), mRNA [NM_005767] |
| 156 | A_23_P302470 | SULT1B1 | TGTCTAAGTCACAAATCTGAAGAAATAAGAGATTGTCTGTGTAGTT GATTGAAACGAGGGCA | SEQ ID NO: 3210 | Homo sapiens sulfotransferase family, cytosolic, 1B, member 1 (SULT1B1), mRNA [NM_014465] |
| 157 | A_23_P302550 | RGS18 | GAGTGTAAGGCCTAGGAGATTTGGGCATCTGCACATTGGTTCA TATCAGAAAGTGTTA | SEQ ID NO: 3211 | Homo sapiens regulator of G-protein signalling 18 (RGS18), mRNA [NM_130782] |
| 158 | A_23_P30307 | CRSP9 | CAATTGTACTGCGACAGAATGAACATCAAAGAGAAAATTCAGGTC ATAGGAGAGATCAGAT | SEQ ID NO: 3212 | Homo sapiens cofactor required for Sp1 transcriptional activation, subunit 9, 33kDa (CRSP9), mRNA [NM_004270] |
| 159 | A_23_P305060 | PBEF1 | TGGCTGTGCTCTATATGCACCTCAAGATTTTAAGGAGATAAT GTTTTAGAGAGAATT | SEQ ID NO: 3213 | Homo sapiens pre-B-cell colony enhancing factor 1 (PBEF1), mRNA [NM_005746] |
| 160 | A_23_P307940 | CAPZA2 | CTACAAGATTGGCAAGAGATGCAGAATGCATAAGAATGAAGATT GCATGACGGGATCATT | SEQ ID NO: 3214 | Homo sapiens capping protein (actin filament) muscle Z-line, alpha 2 (CAPZA2), mRNA [NM_006136] |
| 161 | A_23_P308800 | GLS | CGGAAGAAGAGAATAAGAATACTGCGAATAGGCCCTCAAACTTAAA AAAGAAAAAAACTTGC | SEQ ID NO: 3215 | Homo sapiens glutaminase C mRNA, complete cds. [AF158555] |
| 162 | A_23_P30956 | KIAA0776 | TTTTTTCATTTGTCAAAATGGTTCTTTTGTTGCCAAGTAAAGA ACAGTTTTTATTGTT | SEQ ID NO: 3216 | Homo sapiens KIAA0776 (KIAA0776), mRNA [NM_015323] |
| 163 | A_23_P312246 | CCDC82 | GGCTTTATAACAGATGACGTGTCAAGTGACGTTGATGAGCTGTCTGATATC CTGTCACGTTTAGTCAA | SEQ ID NO: 3217 | Homo sapiens coiled-coil domain containing 82 (CCDC82), mRNA [NM_024725] |
| 164 | A_23_P314191 | ZDHHC17 | TGGATACTTTTAGCAAATAGGACAAAGTTAATTCTCAGCACTGAACA TGAATTAGTTCCTTGG | SEQ ID NO: 3218 | Homo sapiens zinc finger, DHHC-type containing 17 (ZDHHC17), mRNA [NM_015336] |
| 165 | A_23_P31671 | UQCRB | AAGGCATAAGAAGAGACTTCCTGAGAACCTTTATAATGACAGGATG TTTCAGCATTAAGAGGG | SEQ ID NO: 3219 | Homo sapiens ubiquinol-cytochrome c reductase binding protein (UQCRB), mRNA [NM_006294] |
| 166 | A_23_P327022 | MDFIC | TTATGATTTGTTAATGTAAAATGTTTGTTGAAGTATATGGCTA TCATGACTAAGTGCTA | SEQ ID NO: 3220 | Homo sapiens MyoD family inhibitor domain containing (MDFIC), mRNA [NM_199072] |
| 167 | A_23_P33045 | RPL26 | TACAAAGGTCAGCAAATTGGGAAAGTAGTCCAGGTTTACAGGAA GAAATATGTTATCTAC | SEQ ID NO: 3221 | Homo sapiens ribosomal protein L26 (RPL26), mRNA [NM_000987] |
| 168 | A_23_P332439 | NUPL1 | ATTGAAATCTGAATGTTGAATGTATGAACTGTGAAGTACAGAGCGGGT GCCTTTGTAAATGTTC | SEQ ID NO: 3222 | Homo sapiens KIAA0410 mRNA, partial cds. [AB007870] |
| 169 | A_23_P339480 | HAT1 | AACATGAACAGCTGGAAGAGAGTTTCAGGAACTAGTGGAAGAT TACCGGCGTGTTTATTG | SEQ ID NO: 3223 | Homo sapiens histone acetyltransferase 1 (HAT1), transcript variant 1, mRNA [NM_003642] |
| 170 | A_23_P347059 | MOBKL1A | CTAGAAGGGGAAAAATCATCTAAGTTATGAAATCGAAGACATAGGC GCTATATACAAAGTG | SEQ ID NO: 3224 | Homo sapiens MOB1, Mps One Binder kinase activator-like 1A (yeast) (MOBKL1A), mRNA [NM_173468] |
| 171 | A_23_P348992 | MYSM1 | CATGTATTTAAACCTATGAATTATAAAATAGTATTTAGATTCTA GGGTGAGTTAAATAGA | SEQ ID NO: 3225 | Homo sapiens mRNA for KIAA1915 protein, partial cds. [AB067502] |
| 172 | A_23_P349083 | FCHO2 | GTGAAATGGTTAAACTTGTGCACTTGTTAGTTACCACAGTGTT CATACCAAGTATTGGG | SEQ ID NO: 3226 | Homo sapiens FCH domain only 2 (FCHO2), mRNA [NM_138782] |
| 173 | A_23_P353704 | RP5-1022P6.2 | TGTCTCTCACTACGTATTACACAGTGTTGCTTTGTGGGTTTGTT TTGTATGTGCGTGTGT | SEQ ID NO: 3227 | Homo sapiens hypothetical protein KIAA1434 (KIAA1434), mRNA [NM_019593] |
| 174 | A_23_P355067 | TMCO1 | AACTCAAGAACTGTTTATTTTCTATCATTCTGTTTCTAGACACAGA CACATCAGAACTGGGAA | SEQ ID NO: 3228 | Homo sapiens transmembrane and coiled-coil domains 1 (TMCO1), mRNA [NM_019026] |

Fig. 24-10

| No. | Probe ID No. | Symbols of genes | Sequence | SEQ ID NO: | Descriptions of genes [letters and numbers within [ ] indicates GenBank accession No.) |
|---|---|---|---|---|---|
| 175 | A_23_P37736 | TNFRSF17 | GATCTCTTTAGGAGTGATGTATTTTCAGTTGCCGATACAGCTT TTTGTCGTCTAAGTGT | SEQ ID NO: 3229 | Homo sapiens tumor necrosis factor receptor superfamily, member 17 (TNFRSF17), mRNA [NM_001192] |
| 176 | A_23_P38275 | THC2504576 | TCTCGCCAAAATGAAGTTAATCCGTTTGTGACTTCCGACCGAA GCAAGAATCGGCAAAG | SEQ ID NO: 3230 | RL26_BOVIN (P61257) 60S ribosomal protein L26, complete [THC2504576] |
| 177 | A_23_P380734 | FGFR10P2 | CCAACAGATACAGAGAAATGTGCTTAAGATCAGTTGAAACCTAAA TTTCTTATGTGTGG | SEQ ID NO: 3231 | Homo sapiens FGFR1 oncogene partner 2 (FGFR10P2), mRNA [NM_015633] |
| 178 | A_23_P405873 | C9orf72 | GAGAATGGAAGATCAGGGTCAGAGATTATTCAATGCTTACTG GAGAAGTGATTCCTGT | SEQ ID NO: 3232 | Homo sapiens chromosome 9 open reading frame 72 (C9orf72), transcript variant 2, mRNA [NM_145005] |
| 179 | A_23_P41114 | CSTA | AAACAAATGAGACTTATGGAAAATTGGAAGCTGTGCAGTATAAA ACTCAAGTTGTTGCTG | SEQ ID NO: 3233 | Homo sapiens cystatin A (stefin A) (CSTA), mRNA [NM_005213] |
| 180 | A_23_P41645 | ELL2 | TGTCTTTTCAAAGTGCTGCCAGTTGAAAAGGGAAGCATTATGTT TACAAATCTGTTTTGA | SEQ ID NO: 3234 | Homo sapiens elongation factor, RNA polymerase II, 2 (ELL2), mRNA [NM_012081] |
| 181 | A_23_P41664 | ENST00000334994 | TGGCTTGGAGCAGATTCGACTTCATAAACAAATTGTTCCTGAAA ATGAGGCACAGGTCAT | SEQ ID NO: 3235 | Synleurin [Source:Uniprot/SPTREMBL;Acc:Q7Z207] [ENST00000334994] |
| 182 | A_23_P421563 | LSM3 | CATAAGAGAAGAACCTGGATACATTTTGATATTAAGAAATAATTCC GGGGATTCTTCCACTC | SEQ ID NO: 3236 | Homo sapiens LSM3 homolog, U6 small nuclear RNA associated (S. cerevisiae) (LSM3), mRNA [NM_014463] |
| 183 | A_23_P42975 | PRKAR2B | GCCACATTTTAGAAGACTGTTAACATTTTGCAAAAGCTTCT TGTAGGAAAAGAGAGC | SEQ ID NO: 3237 | Homo sapiens protein kinase, cAMP-dependent, regulatory, type II, beta (PRKAR2B), mRNA [NM_002736] |
| 184 | A_23_P494809 | S100A8 | AAAGGCATGAAAGAAACGCACAAAGAGAGTAGGCTGAGTTACTGGGCC CAGAAGCTGGGCCCCT | SEQ ID NO: 3238 | Homo sapiens S100 calcium binding protein A8 (S100A8), mRNA [NM_002964] |
| 185 | A_23_P4257 | COMMD8 | AACATTTTACTTCTGGGCTTCTATGTTTGGGAAACATTGCTCTG ATAAAAATAGCTGTC | SEQ ID NO: 3239 | Homo sapiens COMM domain containing 8 (COMMD8), mRNA [NM_017845] |
| 186 | A_23_P48166 | TWF1 | TGGACAGGACCATAGCTGAAGGTGTTATTTCAGTCAGGAAGAAC AAGCTGTCATGAAGGT | SEQ ID NO: 3240 | Homo sapiens twinfilin, actin-binding protein, homolog 1 (Drosophila) (TWF1), mRNA [NM_002822] |
| 187 | A_23_P48897 | CCPG1 | AAGTCAGAAGAGCTCATATATATAATTGTAATGTGCCACCTATG TCCATCCATCTACCA | SEQ ID NO: 3241 | Homo sapiens cell cycle progression restoration protein (CPR8) mRNA, complete cds. [AF011794] |
| 188 | A_23_P500956 | B3GNT2 | TCCTGGTGGTATCATAGTGTAATTTTAGTATTTGAAAATCAGTG TGATTCCTTAATGGCC | SEQ ID NO: 3242 | Homo sapiens UDP-GlcNAc:betaGal beta-1,3-N-acetylglucosaminyltransferase 2 (B3GNT2), mRNA [NM_006577] |
| 189 | A_23_P501080 | ZNF92 | GAATATTAAGTGCTAGTTGAGGTAGATCAGTCGAAGCTAAGATTCT TTTGCAGTATAGTGAG | SEQ ID NO: 3243 | Homo sapiens zinc finger protein 92 (ZNF92), transcript variant 1, mRNA [NM_007139] |
| 190 | A_23_P502425 | MRPL47 | GTTCCGCACATCTTGCTGAAGAGCCCAAAAGTCAAGTCTTGTCTAAG ATGTGTGAAGTATTAA | SEQ ID NO: 3244 | Homo sapiens mitochondrial ribosomal protein L47 (MRPL47), nuclear gene encoding mitochondrial protein, transcript variant 1, mRNA [NM_020409] |
| 191 | A_23_P50907 | ITGAV | AAAGAGTGATTAAGTAAGGTTATTACCGCTAAATGGTCCATTC TGCATTGTATTTCAGG | SEQ ID NO: 3245 | Homo sapiens integrin, alpha V (vitronectin receptor, alpha polypeptide, antigen CD51) (ITGAV), mRNA [NM_002210] |
| 192 | A_23_P51317 | CCDC76 | CCCTTGTTTATAAGTTTTTATGTCAAGTAAGGTAGTTTGTTTAAGT TAGTTACCCATGTCCC | SEQ ID NO: 3246 | Homo sapiens coiled-coil domain containing 76 (CCDC76), mRNA [NM_019083] |

Fig. 24-11

| No. | Probe ID No. | Symbols of genes | Sequence | SEQ ID NO: | Descriptions of genes (letters and numbers within [ ] indicates GenBank accession No.) |
|---|---|---|---|---|---|
| 193 | A_23_P52846 | THC2694735 | TTTATGCGTTTTCACTACAATAACAAGTAGAACACGTAGAACAGATGATTAGTCACAGCAG | SEQ ID NO: 3247 | AB003177 proteasome subunit p27 [Homo sapiens] (exp=-1; wgp=0; cg=0), partial (0%) [THC2694735] |
| 194 | A_23_P53668 | NFYB | TGGGCTCATATTGTGCATACCATTTGTAACCTGCTTTTTTCACTTAACAATATATTGGG | SEQ ID NO: 3248 | Homo sapiens nuclear transcription factor Y, beta (NFYB), mRNA [NM_006166] |
| 195 | A_23_P56759 | KRCC1 | GATATCCGTGTTCATACCACTTTCTTCTTATGTTGAATAGGTTCTTAACTCTAACAAAGGC | SEQ ID NO: 3249 | Homo sapiens lysine-rich coiled-coil 1 (KRCC1), mRNA [NM_016618] |
| 196 | A_23_P58266 | S100P | CCAAAAGTGTTTGTTGGGAATTATTCCCCTAGGCTGAGCCTGCTCATGTACGTCTGATTA | SEQ ID NO: 3250 | Homo sapiens S100 calcium binding protein P (S100P), mRNA [NM_005980] |
| 197 | A_23_P59637 | DOCK4 | TTGGCAGTGAGCAGTTGAATTTATCTGAATTTATCATGTGTGTATTTCTGAAGCAG | SEQ ID NO: 3251 | Homo sapiens dedicator of cytokinesis 4 (DOCK4), mRNA [NM_014705] |
| 198 | A_23_P59921 | SUB1 | CAGATTGGGAAAATGAGGTACGTTAGTGTTCGCGATTTTAAAGGCAAAGTGCTAATTGAT | SEQ ID NO: 3252 | Homo sapiens SUB1 homolog (S. cerevisiae) (SUB1), mRNA [NM_006713] |
| 199 | A_23_P60565 | ZNF354A | AAACAAAAGCTACTGGAAGAAATACATCCTTGAGAGAGATGTAATAAATGTAATGGATGTG | SEQ ID NO: 3253 | Homo sapiens zinc finger protein 354A (ZNF354A), mRNA [NM_036491] |
| 200 | A_23_P61674 | CLK4 | GAAAGGCATGCAGTTTGTCCAGTTGTGACAGTTGTTTAATAAACCACAATACACACTTTA | SEQ ID NO: 3254 | Homo sapiens CDC-like kinase 4 (CLK4), mRNA [NM_020666] |
| 201 | A_23_P63896 | FAS | ATGTGTATCCACAGGGCTAACCCACTCTATGAATCAATAGAAGAAGCTATGACCTTTTGC | SEQ ID NO: 3255 | Homo sapiens Fas (TNF receptor superfamily, member 6) (FAS), transcript variant 1, mRNA [NM_000043] |
| 202 | A_23_P65768 | C15orf15 | TCCTGCATTGCCATCTACATAATATCAGATATTACGGATGGTAGATTGGCATCTCAGTGTT | SEQ ID NO: 3256 | Homo sapiens chromosome 15 open reading frame 15 (C15orf15), mRNA [NM_016304] |
| 203 | A_23_P66260 | ZNF267 | TGTGATGAATGGTAAAGCCTTCAGCTATAGGTCATACCTCACTACACATGGAGAAGT | SEQ ID NO: 3257 | Homo sapiens zinc finger protein 267 (ZNF267), transcript variant 498723, mRNA [NM_003414] |
| 204 | A_23_P70007 | HMMR | ACTATTTCTTCAGAGTTTGTCATAGTCGTCTGTCATCTGCATGTCTACTCAGCATTTGA | SEQ ID NO: 3258 | Homo sapiens hyaluronan-mediated motility receptor (RHAMM) (HMMR), transcript variant 1, mRNA [NM_012484] |
| 205 | A_23_P70328 | CENPQ | CAATGGCTTAGAGTTCTGTCGTGTCTGGTCATCTGGAACTTGAAAAATCCTCAAATGCCTTCAC | SEQ ID NO: 3259 | Homo sapiens centromere protein Q (CENPQ), mRNA [NM_018132] |
| 206 | A_23_P71727 | CKS2 | GATAAAAGTTCTTCCAGTCAGTCAGTTTTCTCTTAAGTGCCTGTTTGAGTTTAGTGAAACAGT | SEQ ID NO: 3260 | Homo sapiens CDC28 protein kinase regulatory subunit 2 (CKS2), mRNA [NM_001827] |
| 207 | A_23_P7221 | RPL34 | CGAGGAGGCAGAAATCGTTGTGAAAGTGTTGAAGGCACAAGCACAGAGTCAGAAAGCTAA | SEQ ID NO: 3261 | Homo sapiens ribosomal protein L34 (RPL34), transcript variant 2, mRNA [NM_033625] |
| 208 | A_23_P7229 | RPL34 | CGAACCCCTGGTAATAGAATTGTTACCTTTATACCAAGAAGGTTGGGAAAGCACCAAAA | SEQ ID NO: 3262 | Homo sapiens ribosomal protein L34 (RPL34), transcript variant 2, mRNA [NM_033625] |
| 209 | A_23_P72603 | KLHL2 | TTTTTGATATTTAACAATGCTAAAACAGTTTAAATGCCACTCTGAGGAATGCACCTGGTG | SEQ ID NO: 3263 | Homo sapiens kelch-like 2, Mayven (Drosophila) (KLHL2), mRNA [NM_007246] |
| 210 | A_23_P73114 | PROS1 | CCAGAACAAATTTTAACAAAAGGACAACCACAGACAGGGATATAGTGAATATCGTATCATTG | SEQ ID NO: 3264 | Homo sapiens protein S (alpha) (PROS1), mRNA [NM_000313] |
| 211 | A_23_P74001 | S100A12 | TGAAGGCTTTTTACCCAGCAATGTCCTCAATGAGGGTGTTTTCTTTCCCTCACGAAAAGC | SEQ ID NO: 3265 | Homo sapiens S100 calcium binding protein A12 (S100A12), mRNA [NM_005621] |
| 212 | A_23_P75769 | MS4A4A | CACCAAAAGATCAACAGAGACAAATGCTCCAGAAATCTATGGTGACTGTGACAACAAGAGCT | SEQ ID NO: 3266 | Homo sapiens membrane-spanning 4-domains, subfamily A, member 4 (MS4A4A), transcript variant 1, mRNA [NM_024021] |

Fig. 24-12

| No. | Probe ID No. | Symbols of genes | Sequence | SEQ ID NO: | Descriptions of genes (letters and numbers within [ ] indicates GenBank accession No.) |
|---|---|---|---|---|---|
| 213 | A_23_P76480 | BF213738 | AAATCGAAGACGGACAATGGGTAGATGGAGCTACATTTACCAAAT CGTTTGGCATGACAGG | SEQ ID NO: 3267 | BF213738 601847626F1 NIH_MGC_55 Homo sapiens cDNA clone IMAGE:4078519 5', mRNA sequence [BF213738] |
| 214 | A_23_P78092 | EVI2A | GCTGAATCAGACACTTGGAAAAGAACAAAACAGCTCACAGGACC CAACCTAGTAGTGATGCAA | SEQ ID NO: 3268 | Homo sapiens ecotropic viral integration site 2A (EVI2A), transcript variant 1, mRNA [NM_001003927] |
| 215 | A_23_P82047 | BU507302 | TCTGTTTCGTTAATGTCAGGTGCCTGAACATTCAGCAGTTTATA AATTGCTTAATTGTG | SEQ ID NO: 3269 | AGENCOURT_10309688 NIH_MGC_71 Homo sapiens cDNA clone IMAGE:6501220 5', mRNA sequence [BU507302] |
| 216 | A_23_P83278 | CHMP5 | CATTGCTCTTTTATTTTTTCCATTAAGAGACTCATTGCTTGGGA AATGCTTCTTCGTAC | SEQ ID NO: 3270 | Homo sapiens chromatin modifying protein 5 (CHMP5), mRNA [NM_016410] |
| 217 | A_23_P87769 | C12orf48 | GTAAGAAATATCGTCAGTCGTCCTAATGCATATTGTGACTGTTT GCATATACTTCTGTT | SEQ ID NO: 3271 | Homo sapiens chromosome 12 open reading frame 48 (C12orf48), mRNA [NM_017915] |
| 218 | A_23_P87879 | CD69 | TGTCAATATGTGATGTGGCAAATCTCTATTAGGAAAATATTCTG TAATCTCAGACCTAG | SEQ ID NO: 3272 | Homo sapiens CD69 molecule (CD69), mRNA [NM_001781] |
| 219 | A_23_P94095 | ANKRD46 | GCTCTTGGTATTTTCTTGTATGTATCTAGTATGAGG CTTGCTCTTCATGTG | SEQ ID NO: 3273 | Homo sapiens ankyrin repeat domain 46 (ANKRD46), mRNA [NM_198401] |
| 220 | A_23_P94230 | LY96 | TGAAGGTATTTGTGGGAGCCAGAAGAAATGCTCTTTTGCTTGG AGTTGTCATCTACA | SEQ ID NO: 3274 | Homo sapiens lymphocyte antigen 96 (LY96), mRNA [NM_015364] |
| 221 | A_23_P94501 | ANXA1 | GGCTCTTTGTGAAGGAAACTAAACATTCCGTTGATGGTCTCAAG CTATGATCAGAAGACT | SEQ ID NO: 3275 | Homo sapiens annexin A1 (ANXA1), mRNA [NM_000700] |
| 222 | A_23_P95564 | NAT1 | TCGTTGGAGAAGAAGGTTGTGCCCAAACATGGTGATAGATTTTT TACTATTTAGAATAAG | SEQ ID NO: 3276 | Homo sapiens N-acetyltransferase 1 (arylamine N-acetyltransferase) (NAT1), mRNA [NM_000662] |
| 223 | A_23_P99980 | HMGB1 | GGAATCTTTTCCATTTGTTTATGTAATTCAGGAGGAAT ACTGAACATCTGAGTC | SEQ ID NO: 3277 | Homo sapiens high-mobility group box 1 (HMGB1), mRNA [NM_002128] |
| 224 | A_24_P100387 | GK | TAAAGGTTCTGTTTTTGTTTGGAATCAATGAGCTTATTGAC TGTTCTGATTGTGCTG | SEQ ID NO: 3278 | Homo sapiens glycerol kinase (GK), transcript variant 1 mRNA [NM_203391] |
| 225 | A_24_P100830 | AMN1 | TCTTGAAAGAATTTAGGTATTTGTTTCACGGAGAAATGAAGTGACT TATTAGCCATTCAGCG | SEQ ID NO: 3279 | Homo sapiens antagonist of mitotic exit network 1 homolog (S. cerevisiae) (AMN1), mRNA [NM_207337] |
| 226 | A_24_P105648 | BX111927 | TTATGAGATGCTTCAGTTCCAGGTGTACAAGAAGAAATATGTCATCTACA TATCTAAAAGAGTGCC | SEQ ID NO: 3280 | BX111927 Soares_multiple_sclerosis_2NbHMSP Homo sapiens cDNA clone IMAGp998G05619, mRNA sequence [BX111927] |
| 227 | A_24_P106306 | RPL26L1 | TGGCAAGGTAGTCCAGGTGTACAGAAGAAGAAATATGTCATCTACA TCGAGCGGGTGCAGCGG | SEQ ID NO: 3281 | Homo sapiens ribosomal protein L26-like 1 (RPL26L1), mRNA [NM_016093] |
| 228 | A_24_P11045 | THC2785765 | CCACCAGAAACGTACACGTGATTTTCATGACAAATACGGTAGCA ACACAGTCGGAATAG | SEQ ID NO: 3282 | COX7B_HUMAN (P24311) Cytochrome c oxidase polypeptide VIIb, mitochondrial precursor partial (78%) [THC2785765] |
| 229 | A_24_P114249 | GALNT3 | ATTTCAAATGCAGAATACTTGACTGCATTTAAAGCTAAATTTTGT TACTGATTCAATTATA | SEQ ID NO: 3283 | Homo sapiens UDP-N-acetyl-alpha-D-galactosamine:polypeptide N-acetylgalactosaminyltransferase 3 (GalNAc-T3) (GALNT3), mRNA [NM_004482] |
| 230 | A_24_P113382 | A_24_P113382 | CATACCATGTCTGTGTGTGGTTGTCCAGAAAATGAGGCTGAAGA TTCACCAAATAAGCTC | SEQ ID NO: 3284 | |
| 231 | A_24_P127621 | A_24_P127621 | TCGAAGCAAGTACCACCAAAAGGCATTGAATGCACTTGCACA TTCTGAAAATATTAG | SEQ ID NO: 3285 | |

Fig. 24-13

| No. | Probe ID No. | Symbols of genes | Sequence | SEQ ID NO: | Descriptions of genes (letters and numbers within [ ] indicates GenBank accession No.) |
|---|---|---|---|---|---|
| 232 | A_24_P133991 | ANKRD12 | TTTGGAATGGAGTATATGGCTGAAAAGGTTTTGGATTCAGAAAAG AAAAAGGATGGTTAGT | SEQ ID NO: 3286 | Homo sapiens ankyrin repeat domain 12 (ANKRD12), mRNA [NM_015208] |
| 233 | A_24_P134392 | STCH | TGAGTAACTTATTTTGTATCAGGAATGTTTTGGTTACTGTGTTTT CACTCAAACCACTGAC | SEQ ID NO: 3287 | Homo sapiens stress 70 protein chaperone, microsome-associated, 60kDa (STCH), mRNA [NM_006948] |
| 234 | A_24_P135242 | A_24_P135242 | GATGGCAAGAAAAGCTGGGAAGTAGTTTGTAGCTGCAGAACCCA AACTGGCATTTGTCAT | SEQ ID NO: 3288 | |
| 235 | A_24_P135551 | LOC130865 | TAACAGCATAGCTGTCCCTGTGGGGATTCAGCCAAAGGTGGTTA TCACTAGACTAAAACT | SEQ ID NO: 3289 | PREDICTED: Homo sapiens similar to 60S ribosomal protein L26 (Silica-induced gene 20 protein) (SIG-20) (LOC130865), mRNA [XR_019454] |
| 236 | A_24_P144666 | LOC401975 | TGTCGATGTGAAGAGTAATGATGGCTACTTCTTTAATCTGTTCT GTGTTGGTTTTAGTGA | SEQ ID NO: 3290 | PREDICTED: Homo sapiens similar to ribosomal protein S3a (LOC401975), mRNA [XR_017247] |
| 237 | A_24_P152753 | LOC285260 | TGTCTCATACCGAATCCGTGTGGGATTATCCAGAAAGATGAAGG ATTCACCAAATGAGCT | SEQ ID NO: 3291 | PREDICTED: Homo sapiens similar to ribosomal protein L31 (LOC285260), mRNA [XR_019376] |
| 238 | A_24_P163324 | LOC390413 | GAAGCTTAACACATGCTTCAATTAACATGCTGGGGATTGTAGAAC CATATATTGCAGGGTA | SEQ ID NO: 3292 | PREDICTED: Homo sapiens similar to 60S ribosomal protein L7 (LOC390413), mRNA [XR_018341] |
| 239 | A_24_P165864 | P2RY14 | TTTTTCTGGAAAACAGAGGGATTTTACTTCTGGAGACATGGCAT ACGGTTACTGAGTTAT | SEQ ID NO: 3293 | Homo sapiens purinergic receptor P2Y, G-protein coupled, 14 (P2RY14), transcript variant 2, mRNA [NM_014879] |
| 240 | A_24_P175176 | PHTF2 | AGATTAGGGTTAACTTAGAGTTGGGAGTTGGATTTATTAAGTACA GTATACCTGTCAACAG | SEQ ID NO: 3294 | Homo sapiens putative homeodomain transcription factor 2 (PHTF2), mRNA [NM_020432] |
| 241 | A_24_P188878 | RPL34 | TGTTTAGCTTTATCCAAGAAGAAGGTTGGGAAAGCACAAAATCTG CATGTGGTGTGTGCC | SEQ ID NO: 3295 | Homo sapiens ribosomal protein L34 (RPL34), transcript variant 2, mRNA [NM_033625] |
| 242 | A_24_P201702 | CLEC2B | ATTGGAATTCAAGTAAATACAACTGTTCGACTCAACATGCCGAC CTAACTATAATTGACA | SEQ ID NO: 3296 | Homo sapiens C-type lectin domain family 2, member B (CLEC2B), mRNA [NM_005127] |
| 243 | A_24_P203909 | RPL34 | GAGGGGTTCGTGCTGAGTAAGACTAAAGTTCTATATGAAATTGTCC AAAACAAACAACATG | SEQ ID NO: 3297 | Homo sapiens ribosomal protein L34 (RPL34), transcript variant 1, mRNA [NM_033625] |
| 244 | A_24_P20996 | BC043173 | CTGAAAATGTTGATATATATGCAAAAATGGCAGGACAATGATCTTCAT GAAGGGCTCTGATTGG | SEQ ID NO: 3298 | Homo sapiens cDNA clone IMAGE:5287121. [BC043173] |
| 245 | A_24_P213375 | A_24_P213375 | AAATGTGTTCCATGATCAAAAATGCAAAATGGCAGACAATGATCTTCAT CTGTTCTGTGTTGGTT | SEQ ID NO: 3299 | |
| 246 | A_24_P213783 | RPL31 | CTTTGGTTAGCTATGTACGTGTTACCACTTTCAAAAATGTACAG ACAGTCAATGTGGATG | SEQ ID NO: 3300 | Homo sapiens ribosomal protein L31 (RPL31), mRNA [NM_000993] |
| 247 | A_24_P221375 | A_24_P221375 | TACTTTGGTTACCCATGTACCACTTTCAAAAAATCTACAGA GAGTCAATGTGGAGGA | SEQ ID NO: 3301 | |
| 248 | A_24_P225308 | ARID4B | GTTGAAAATGTTTCAAGTATTCAAATTTGTACAGGACTGTAA AGATTTGTTGACAGACA | SEQ ID NO: 3302 | Homo sapiens AT rich interactive domain 4B (RBP1-like) (ARID4B), transcript variant 1, mRNA [NM_016374] |
| 249 | A_24_P225719 | PREI3 | GACTATTTTCTTAGTGAATATTTATACTAAGGTAGTGACTGAGA TTTGGTGATCTGGCTG | SEQ ID NO: 3303 | Homo sapiens preimplantation protein 3 (PREI3), transcript variant 1, mRNA [NM_015387] |
| 250 | A_24_P235429 | ABCA1 | CCAAAGAGCCATGTGTCATGAATGAATACTGAACCACTTTGATATTG AGACATTAATTTGTAC | SEQ ID NO: 3304 | Homo sapiens ATP-binding cassette, sub-family A (ABC1), member 1 (ABCA1), mRNA [NM_005502] |

Fig. 24-14

| No. | Probe ID No. | Symbols of genes | Sequence | SEQ ID NO: | Descriptions of genes (letters and numbers within [ ] indicates GenBank accession No.) |
|---|---|---|---|---|---|
| 251 | A_24_P235008 | SCYL2 | ATAGACTATGTACTTCGTCTGGTTTTTGTTTTATTTGGAATGGTTATAAGGGTCC | SEQ ID NO: 3305 | Homo sapiens mRNA for KIAA1360 protein, partial cds. [AB037781] |
| 252 | A_24_P243749 | PDK4 | ATTTGACATTTGTGTGTAATTTCATGGTGGCCTAGTGTTGTGGTGCTTCTGTAATGGTA | SEQ ID NO: 3306 | Homo sapiens pyruvate dehydrogenase kinase, isozyme 4 (PDK4), mRNA [NM_002612] |
| 253 | A_24_P24890 | A_24_P24890 | ATGAAGGAGATTTGGTCTTTGTATTGTTACGTTCCTCGTACTTTGTAGCTGTGGCTGTACT | SEQ ID NO: 3307 | |
| 254 | A_24_P264549 | A_24_P264549 | ATTCATAGTAGGCATACAGAGAACATGATCAAAGGTGTTACACTGGACTTCCATTACAATATG | SEQ ID NO: 3308 | |
| 255 | A_24_P268917 | RAB33B | CCCAGAATGCTAATGTAGTTCGGCTATTAATAACAATGCATTATTGAAAGTATATTGGAAAT | SEQ ID NO: 3309 | Homo sapiens RAB33B, member RAS oncogene family (RAB33B), mRNA [NM_031296] |
| 256 | A_24_P273583 | TMCO1 | CCTTCATTTTCCTGTATATTCTCTGTACTATGTCGATTCGACAGAACATTCAGAAGATTC | SEQ ID NO: 3310 | Homo sapiens transmembrane and coiled-coil domains 1 (TMCO1), mRNA [NM_019026] |
| 257 | A_24_P278460 | MLSTD2 | ACCCATGGAACAATATGCTTAGGATTACAGGAAGCAGTCCTTACTTACACTTCTTGTCTG | SEQ ID NO: 3311 | Homo sapiens male sterility domain containing 2 (MLSTD2), mRNA [NM_032228] |
| 258 | A_24_P286054 | ZFYVE16 | GTGTATGTATTCTGCCATGTAAGTAATTGAACAGTGTTAAAATAAGCAAATGGTAGAAGGG | SEQ ID NO: 3312 | Zinc finger FYVE domain-containing protein 16 (Endofin) (Endosome-associated FYVE domain protein). [Source:Uniprot/SWISSPROT:Acc:Q7Z3T8] [ENST00000360248] |
| 259 | A_24_P298238 | A_24_P298238 | ATCCTTGAAGGAAATGACATTGAGGTTGTTTCAATTCAGCAAGCCACAACAGTTAAAAAC | SEQ ID NO: 3313 | |
| 260 | A_24_P298604 | LOC731599 | GATGGAAATCATGAACCAGAGAGGTTGGGGCAAATGAGTTGAAAGAATTGGTCAATAAAATGAT | SEQ ID NO: 3314 | PREDICTED: Homo sapiens hypothetical protein LOC731599 (LOC731599), mRNA [XR_015536] |
| 261 | A_24_P303118 | RPL34 | CGAGGAGCAGAAAAATGGTTGTGTGAAAGTGTTGAAGGGACAAGCAGAGAGTCAGAAGGTAA | SEQ ID NO: 3315 | Homo sapiens ribosomal protein L34 (RPL34), transcript variant 2, mRNA [NM_033625] |
| 262 | A_24_P306527 | ENST00000308899 | ACGGCATCCGTCCGTGGTTATCCAGAAATGTAATGAGGATGAAGATTCACCAAATAAGT | SEQ ID NO: 3316 | PREDICTED: Homo sapiens similar to ribosomal protein L31 (LOC729005), mRNA [XM_001133428] |
| 263 | A_24_P315326 | LOC344412 | AAGCTCTATACTTTGGTTACCAAATGTACCGGTTACGGCTTTCAAAAATCACAGGGAATG | SEQ ID NO: 3317 | AGENCOURT_10640855 NIH_MGC_126 Homo sapiens cDNA clone IMAGE:6723568 5', mRNA sequence [CA455253] |
| 264 | A_24_P316074 | LOC730902 | TATCAAATGGTGTGAGCCCAAAAGTGAAGGTCAAAGGTGTTGCAGCTTCTTCCCTTCGTCAAATCTT | SEQ ID NO: 3318 | PREDICTED: Homo sapiens similar to 60S ribosomal protein L7 (LOC730902), mRNA [XR_015660] |
| 265 | A_24_P326328 | SUB1 | CAGAAAAACCTGTAAAGAAACAAGAACAGGTGAGAGACTTCGAGAGCCCGTGTCATGTCTA | SEQ ID NO: 3319 | Homo sapiens SUB1 homolog (S. cerevisiae) (SUB1), mRNA [NM_006713] |
| 266 | A_24_P324224 | A_24_P324224 | AAAGCTGTGTGGGCAAAGGAATAAGGAATTCGTATAGGCATGTGCGGTTGTCCAGAAAA | SEQ ID NO: 3320 | |
| 267 | A_24_P324581 | KIAA1466 | ATAATAGGTCATAGAATGAATTGGTGTACGGAACCAAGGGTAAAAGAATTTAAGTAGCCC | SEQ ID NO: 3321 | Homo sapiens mRNA for KIAA1466 protein, partial cds. [AB040899] |
| 268 | A_24_P33213 | A_24_P33213 | GACCATATATTACGTGGGGGTACGGAAATGTGAAGTCAGTAAATGAACTTAGAAGG | SEQ ID NO: 3322 | |
| 269 | A_24_P333052 | A_24_P333052 | TAGACATCAAGAAATGGATACTGTTCAAAAATGCCCACAAATGTTAACCATGGCAAA | SEQ ID NO: 3323 | |
| 270 | A_24_P333112 | A_24_P333112 | GGTCATCAGAATCAGAAGGTATCAATGTGTGAGCCCAGCAGGACGAAAAGGTATTGCAACTT | SEQ ID NO: 3324 | |

Fig. 24-15

| No. | Probe ID No. | Symbols of genes | Sequence | SEQ ID NO: | Descriptions of genes (letters and numbers within [ ] indicates GenBank accession No.) |
|---|---|---|---|---|---|
| 271 | A_24_P33807 | LOC652558 | TAAGAAAATAATTGGTTTGACAGACAAGCTTTGATTGCTCCATGTCTTGGTAAATATGG | SEQ ID NO: 3325 | PREDICTED: Homo sapiens similar to 60S ribosomal protein L7 (LOC652558), mRNA [XR_019386] |
| 272 | A_24_P344537 | ZNF625 | TCGAGCGGTTAAAATCCAGTGAAAGGCTCACAGTGGAGAAAAACCCTGTAGCTCCAACACT | SEQ ID NO: 3326 | Homo sapiens zinc finger protein 625 (ZNF625), mRNA [NM_145233] |
| 273 | A_24_P349636 | LOC388401 | AGTTGCTTGGACAGATAACACTTTGATTGCTCGATCTCTTGGTAAATATAGGATCAACTG | SEQ ID NO: 3327 | PREDICTED: Homo sapiens similar to 60S ribosomal protein L7 (LOC388401), mRNA [XR_016879] |
| 274 | A_24_P364025 | UBE2D1 | ATGTGATGGGTGTAGTCATTAAGAAAGCATTTAAATACACTTGAGTATTTTGTCATGGTTC | SEQ ID NO: 3328 | Homo sapiens ubiquitin-conjugating enzyme E2D 1 (UBC4/5 homolog, yeast) (UBE2D1), mRNA [NM_003338] |
| 275 | A_24_P364807 | AYTL1 | TGTAACTCTTGTTCTAGGTAATCGTTCTGTCTCAACAAACTTGTCAAGGGTGTGTGTAA | SEQ ID NO: 3329 | Homo sapiens mRNA; cDNA DKFZp686H22112 (from clone DKFZp686H22112). [BX641069] |
| 276 | A_24_P366165 | LOC391126 | ACTTCGAAGCAAATCAAAATAGGAAAAGGCATTTGAATGCACCTTCCCACATTCACAGG | SEQ ID NO: 3330 | PREDICTED: Homo sapiens similar to 60S ribosomal protein L26 (Silica-induced gene 20 protein) (SIG-20) (LOC391126), mRNA [XR_019504] |
| 277 | A_24_P366546 | RPL31P10 | CGGCTGTGCAGAAGAACGGTATGAGGATGAAGATCAAATAAGCTGTATACTTGGTTACC | SEQ ID NO: 3331 | PREDICTED: Homo sapiens similar to ribosomal protein L31 (LOC390283), mRNA [XR_018695] |
| 278 | A_24_P367191 | LOC652890 | AGTTAACATGCTCAGGACTGTAGAGGCCATATATTGCCTGTCTGTGGGTACCCAAATCTGAAGTC | SEQ ID NO: 3332 | PREDICTED: Homo sapiens similar to 60S ribosomal protein L7 (LOC652890), mRNA [XR_019544] |
| 279 | A_24_P367199 | A_24_P367199 | TCTTATGCTCAGCACCAACAGTCTGCCAAATCCAGAAGAAGGTGTAATCATGACCTGAGA | SEQ ID NO: 3333 | |
| 280 | A_24_P367369 | A_24_P367369 | ATTTAAAGGTTTCGATGTTAGAATTCTCTGGTCGGTCGAGGATATCCAAGTGAACAAAGCATCTAA | SEQ ID NO: 3334 | |
| 281 | A_24_P375932 | A_24_P375932 | ATGGTTAAAAATCGAGAGGAACAATGCAGAAACTTAAGGGTTTAGATGTAGATTGTCTGGTC | SEQ ID NO: 3335 | |
| 282 | A_24_P381825 | PSMC6 | ATGAAAGCAGTCAGAAAGTCGGTCGATTGCTAAGAAGGTGGAGTCTAAATTGGACTACAAA | SEQ ID NO: 3336 | Homo sapiens proteasome (prosome, macropain) 26S subunit, ATPase, 6 (PSMC6), mRNA [NM_002806] |
| 283 | A_24_P383999 | RPS3A | TGGTTTTTGTCGTAAAAGCGAACAATCAGATACAACAGAGAAGACGTCTTATGGCAGACCAACG | SEQ ID NO: 3337 | Homo sapiens ribosomal protein S3A (RPS3A), mRNA [NM_001006] |
| 284 | A_24_P384411 | A_24_P384411 | ATGGGAAAATCAATAAGAGTGAAGCTTTGACAGATAATGCTTTGACAGCTCGATCTCTTG | SEQ ID NO: 3338 | |
| 285 | A_24_P384539 | LOC730452 | GAAGAAAAGCTGGCAACTTTCTATGTACCCACGAAGCCAAATTGGCATTTGTCATCAGGA | SEQ ID NO: 3339 | PREDICTED: Homo sapiens similar to 60S ribosomal protein L7 (LOC730452), mRNA [XM_001125895] |
| 286 | A_24_P392622 | A_24_P392622 | CATGGAATTGTTCCTTTGGCACACAGTGATCTATAAGAAAGATGATATTGTAGACACCAAA | SEQ ID NO: 3340 | |
| 287 | A_24_P39378 | CCPG1 | TACTTTTGTCGCTGGAACGAACGTGATCAGTTCATCAATAAGTTTTGGTAAAGGGTGT | SEQ ID NO: 3341 | Homo sapiens cell cycle progression 1 (CCPG1), transcript variant 1, mRNA [NM_004748] |
| 288 | A_24_P403303 | PHF20L1 | AAAGCGAGTTATAAAGGTCTTAATTAGATCGAATTGGATCAGCAATAGACCTAAAGG | SEQ ID NO: 3342 | Homo sapiens PHD finger protein 20-like 1 (PHF20L1), transcript variant 3, mRNA [NM_198513] |
| 289 | A_24_P414556 | TTC33 | TACTCAACATTTGCTATATTGTTTTGAGTAATGGATGTTTGTTTTTTGTGTTAATTTGTGA | SEQ ID NO: 3343 | Homo sapiens tetratricopeptide repeat domain 33 (TTC33), mRNA [NM_012382] |
| 290 | A_24_P41551 | LOC641790 | AGGAGATGGGAACTCCTGATGTGGCATTGTGATATGAGGCACAACAAAGTGCTAGTCTGGAAA | SEQ ID NO: 3344 | PREDICTED: Homo sapiens similar to ribosomal protein L31 (LOC641790), mRNA [XR_018025] |

Fig. 24-16

| No. | Probe ID No. | Symbols of genes | Sequence | SEQ ID NO: | Descriptions of genes (letters and numbers within [ ] indicates GenBank accession No.) |
|---|---|---|---|---|---|
| 291 | A_24_P418712 | A_24_P418712 | AGGGTCAACAAAGCTGTCTGGGGCAAAGAATAAGGAATATCGATACCATATGTGTGTTA | SEQ ID NO: 3345 | |
| 292 | A_24_P4877 | ZCRB1 | GAAAAATTAATAGTATCATGTTAATACTATTATTGTCATCCCAAGAAAAAAGATATTTA | SEQ ID NO: 3346 | Homo sapiens zinc finger CCHC-type and RNA binding motif 1 (ZCRB1), mRNA [NM_033114] |
| 293 | A_24_P60437 | BC065737 | TGCAGAATGATGAAGTTGACATTTAGAAAATTCCTGATTAGTGAAGATGTTCAGGGCAAA | SEQ ID NO: 3347 | Homo sapiens cDNA clone IMAGE:30404477, partial cds. [BC065737] |
| 294 | A_24_P538403 | ROCK1 | TTAAGAGGTTTGTTGGACTTTCATAAATTGAGTAGAATGTTTGAATCAAAGTACCTGCTAC | SEQ ID NO: 3348 | Homo sapiens Rho-associated, coiled-coil containing protein kinase 1 (ROCK1), mRNA [NM_005406] |
| 295 | A_24_P54178 | TMED5 | GCTCTGTATATGCATTTGGATGATTAATGTTATGTGTTCTTTCATGTGAATGTCAAGACA | SEQ ID NO: 3349 | Homo sapiens transmembrane emp24 protein transport domain containing 5 (TMED5), mRNA [NM_016040] |
| 296 | A_24_P557232 | CB111670 | GTTTCTTCTTGGTCAAAAACACACTCAAGTCGTCTCCAAGTTCGAAGCATTCAGCAAACAA | SEQ ID NO: 3350 | K-EST0153390 L5HLK1 Homo sapiens cDNA clone L5HLK1-3-D02 5', mRNA sequence [CB111670] |
| 297 | A_24_P6252 | AF086032 | GTATCTAAAACTGAAACAGGCTACTGTGCTATATTGATTTTATTGGTAGTATTGAGCAGACC | SEQ ID NO: 3351 | Homo sapiens full length insert cDNA clone YW25G09. [AF086032] |
| 298 | A_24_P57837 | THC2567891 | AGAAATCCGGAAAGACCTCTTATGCTCAGTAGGACAAATCCGGAAGAAGATGATGGAAA | SEQ ID NO: 3352 | Q6NXR8_HUMAN (Q6NXR8) Ribosomal protein S3a, partial (91%), [THC2567891] |
| 299 | A_24_P587938 | A_24_P587938 | CTTCAAAGAAGCAAAAGGTGGAGATGCTGGGAACAGGAGGACCAGATTAACAGTCTTAT | SEQ ID NO: 3353 | |
| 300 | A_24_P606663 | LOC392030 | TGTGCGGTTGCCCAGAGCAAAAGCGTAATGCGGGTGAAGATTCACCAGATAAGCTCCATACTT | SEQ ID NO: 3354 | PREDICTED: Homo sapiens hypothetical LOC392030 (LOC392030), mRNA [XR_018063] |
| 301 | A_24_P62860 | STAM2 | GTCTATATGGTACGTACTTGATCTACATTTAACGTGGAAAATTAGGAGTATTTGAAAGGTCAGT | SEQ ID NO: 3355 | Homo sapiens signal transducing adaptor molecule (SH3 domain and ITAM motif) 2 (STAM2), mRNA [NM_005843] |
| 302 | A_24_P630039 | AL049321 | AAGATGAGACAATACAAAGTTACATTTTGGACAGATATTAAAACTGGAGAAGACAGGGG | SEQ ID NO: 3356 | Homo sapiens mRNA; cDNA DKFZp564D156 (from clone DKFZp564D156). [AL049321] |
| 303 | A_24_P63347 | PF4V1 | CTACATTTACCTTGAATGTTAGCATTAGCTTGGCAATAATATTAGTAGCTCTTAAGC | SEQ ID NO: 3357 | Homo sapiens platelet factor 4 variant 1 (PF4V1), mRNA [NM_002620] |
| 304 | A_24_P652786 | THC2533996 | TGGTTGTTCGTATCTCAGCCGGAACGATGATTATCCTTGAGGAATGACATTGAGCTGTTT | SEQ ID NO: 3358 | HSU09964 ribosomal protein L9 [Homo sapiens] (exp=-1; wgp=0; cg=0), partial (42%) [THC2533996] |
| 305 | A_24_P685729 | A_24_P685729 | TTGAAGCTTATGTTGATGTCAAGACTATCAGTGATTATTGCTTTGTCGTTTTGTGG | SEQ ID NO: 3359 | |
| 306 | A_24_P6975 | LOC342994 | GGAAGACTTCGAGGGGTTCGTCGTCGTAAGACCTAAAGTTGTTATGAAATTGTCAAAAGA | SEQ ID NO: 3360 | PREDICTED: Homo sapiens similar to ribosomal protein L34 (LOC342994), mRNA [XM_938484] |
| 307 | A_24_P75158 | PTAR1 | CCATTAGATTTGTTCTTATGTCAACGATGACCAAGCGAGCTATAAGTATTGTATTTCTG | SEQ ID NO: 3361 | Homo sapiens mRNA; cDNA DKFZp313P0917 (from clone DKFZp313P0917). [AL832683] |
| 308 | A_24_P755505 | A_24_P755505 | ATACAGAGACCTCTTATGCTCAGGACCAACAGAGAAAGTAAAATGCTGAAGAAGCCCAA | SEQ ID NO: 3362 | |
| 309 | A_24_P76358 | LOC643981 | TTACTGAAGATGTTCAGGGCAAAAACTGCCTAACTTCCGGCATGGATCTTATTCGTGACA | SEQ ID NO: 3363 | PREDICTED: Homo sapiens similar to 40S ribosomal protein S3a (V-fos transformation effector protein) (LOC643981), mRNA [XR_018444] |

Fig. 24-17

| No. | Probe ID No. | Symbols of genes | Sequence | SEQ ID NO: | Descriptions of genes (letters and numbers within [ ] indicates GenBank accession No.) |
|---|---|---|---|---|---|
| 310 | A_24_P792734 | PSMC3 | AGAACGTTAACGGAGTTACTGAATGAAATGGATGATTGATAC TGTGATAGAGTTAAA | SEQ ID NO: 3364 | Homo sapiens protasome (prosome, macropain) 26S subunit, ATPase, 6 (PSMC6), mRNA [NM_002806] |
| 311 | A_24_P82630 | SMCHD1 | TGTTTAATATGTAACACGTAAGAACAATGAAATTTTCTTCTAA GATTTAATACTATCT | SEQ ID NO: 3365 | Homo sapiens mRNA for KIAA0650 protein, partial cds. [AB014560] |
| 312 | A_24_P83968 | LOC730887 | ACAAAGCCCAGCAGAACAACGTGGAACAACAGAGAAACTTTTCT GGTGTGTCTAAGAAGC | SEQ ID NO: 3366 | PREDICTED: Homo sapiens similar to 40S ribosomal protein S7 (S8) (LOC730887), mRNA [XR_015607] |
| 313 | A_24_P84808 | LOC729449 | GAATTGGTTGACAGATAAGACGTCTTGCGATCTCTTGGAAAATAT GGGATCATCTGTATGG | SEQ ID NO: 3367 | PREDICTED: Homo sapiens similar to 60S ribosomal protein L7 (LOC729449), mRNA [XR_015548] |
| 314 | A_24_P850187 | A_24_P850187 | TAAATGAAGTAATCTACAAGGGTGGTTATGGCAAATCAATTG AGTTGCACTTTCCTAG | SEQ ID NO: 3368 | |
| 315 | A_24_P867201 | AK022997 | CTGACATGTGATAAATATTTCAGTGACTTTCAGATTTATTTCT TGTTAGCCGCTGTGTC | SEQ ID NO: 3369 | Homo sapiens cDNA FLJ12935 fis, clone NT2RP2004982. [AK022997] |
| 316 | A_24_P91852 | DYNLT3 | ATAGACATAGAGAGCGGAACACATAACTCATTGAATTTGGAGAG GAATAAGGTTAGGGTT | SEQ ID NO: 3370 | Homo sapiens dynein, light chain, tctex-type 3 (DYNLT3), mRNA [NM_006520] |
| 317 | A_24_P935985 | BCAT1 | ATGCTGTCGAAGGTTTTGTAGAAGCACAGATTAAACATCTAAAATG GCTTGTTACACCAGA | SEQ ID NO: 3371 | Homo sapiens branched chain aminotransferase 1, cytosolic (BCAT1), mRNA [NM_005504] |
| 318 | A_24_P940426 | QKI | AAGCTGTTGAATGAGTCTTAAAATTATACTACTGTGTAAGTGGA CCAAGTTTGGTGAAGC | SEQ ID NO: 3372 | Homo sapiens quaking homolog, KH domain RNA binding (mouse) (QKI), transcript variant 4, mRNA [NM_206855] |
| 319 | A_24_P99046 | STK38L | GCTATGTGTCTTTGCTGATCGATCACAAATAAATGAATGAGAATT TAGTCCATAGAGGTCC | SEQ ID NO: 3373 | Homo sapiens serine/threonine kinase 38 like (STK38L), mRNA [NM_015000] |
| 320 | A_32_P10100 | A_32_P10100 | TATGAGGAAATAGTATCATCATGTTAGAAGCCTTGGAATGACTA TAAATAATGGCTGGTC | SEQ ID NO: 3374 | |
| 321 | A_32_P105397 | THC2642694 | TAAAATGCTACTACAGTATTCTACGATGCAGCGTGAATGTATAT TACAGATAATTCTCTGG | SEQ ID NO: 3375 | Q6TDT1_HUMAN (Q6TDT1) Protein transactivated by hepatitis B virus E antigen, partial (11%) [THC2642694] |
| 322 | A_32_P107935 | DB527271 | GTTTTATGTGAAATAGAGTTTTCAGATTTATGTAGGATGGAAAG TTTTAATACGTCAGAG | SEQ ID NO: 3376 | DB527271 RIKEN full-length enriched human cDNA library, testis Homo sapiens cDNA clone H013095P12 3', mRNA sequence [DB527271] |
| 323 | A_32_P109036 | ZNF493 | AAAGAGGTCAATATCTGCTGCTCACATCTTACTAAACACCAGAGAGT TCATGCTTAATAAAAG | SEQ ID NO: 3377 | Homo sapiens zinc finger protein 493 (ZNF493), transcript variant 1, mRNA [NM_175910] |
| 324 | A_32_P113154 | LOC730861 | ACGACCAAGTTGCAAGAATCGTCTTAAAGTTCAGACTTAAAACAGT ACCAAATAAAAGTCC | SEQ ID NO: 3378 | PREDICTED: Homo sapiens similar to 40S ribosomal protein S3a (V-fos transformation effector protein) (LOC730861), mRNA [XR_015591] |
| 325 | A_32_P114215 | COMMD6 | AATTGCTATCATTCTAAAGTCATGGAGTTGACTTCAGCTTCCGCAACAA AACTAAGGATGG | SEQ ID NO: 3379 | Homo sapiens COMM domain containing 6 (COMMD6), transcript variant 2, mRNA [NM_203495] |
| 326 | A_32_P11451 | NMD3 | CAGTTTAGGGCAGTAGCTGGTTTTGTGATAAATATGTTCCTACC ACATCAAAATGCTGC | SEQ ID NO: 3380 | Homo sapiens NMD3 homolog (S. cerevisiae) (NMD3), mRNA [NM_015938] |
| 327 | A_32_P11931 | LOC441073 | GTGTGATCGATGCCATCCGAAAAGGATGATGAAGGTTCAGGTTGT ACGTGGACACTATAAA | SEQ ID NO: 3381 | PREDICTED: Homo sapiens similar to 60S ribosomal protein L26 (Silica-induced gene 20 protein) (SIG-20) (LOC441073), mRNA [XR_016376] |
| 328 | A_32_P125549 | RPL31P4 | TCTACAGACAGTCAATGTGATGGATGAGAACTAATCCCTGATGATGTCA GATAGATCAAATAAAG | SEQ ID NO: 3382 | PREDICTED: Homo sapiens ribosomal protein L31 pseudogene 4 (RPL31P4), mRNA [XR_018222] |

Fig. 24-18

| No. | Probe ID No. | Symbols of genes | Sequence | SEQ ID NO: | Descriptions of genes (letters and numbers within [ ] indicates GenBank accession No.) |
|---|---|---|---|---|---|
| 329 | A_32_P125917 | THC2753798 | GGCTATAAAGTGTAAGTGGAGACGGCTAAATTGTGAGTACAAAGTTTCTTTTTCACAACAG | SEQ ID NO: 3383 | BF238843 601904445F1 NIH_MGC_54 Homo sapiens cDNA clone IMAGE:4132429 5', mRNA sequence [BF238843] |
| 330 | A_32_P127454 | A_32_P127454 | GGACAGGTTCGATTCTATTCGGAACTTGGTTGCTGCTTACATATGTCCATGTAACAATACAGAA | SEQ ID NO: 3384 | |
| 331 | A_32_P128781 | A_32_P128781 | CATATATTGCATGGGGGTACCCAATCTGAAGTCAGTAATGAACTAATCTCACAAGAGTC | SEQ ID NO: 3385 | |
| 332 | A_32_P135818 | RPS3A | CTTGGTTCATCTGTTCTGTGTTGGTTTTAATAAAAAGGAACAATCAGATATGGAAGAG | SEQ ID NO: 3386 | Homo sapiens ribosomal protein S3A (RPS3A), mRNA [NM_001006] |
| 333 | A_32_P137266 | KIAA1799 | AAGTGGGACCCAAATCTACAATGGTTTGTCAACATGTAATGCCTTTGAATGAACGACAAG | SEQ ID NO: 3387 | Homo sapiens KIAA1799 protein (KIAA1799), mRNA [NM_032437] |
| 334 | A_32_P145153 | RPL31 | ATCGGTGTGCAGGTGTCCAGAAAACGTAATGAGGATGAAGAATTCACCAAATAAGCCATAT | SEQ ID NO: 3388 | Homo sapiens ribosomal protein L31 (RPL31), mRNA [NM_000993] |
| 335 | A_32_P153725 | KIAA1033 | TTTTGTAAAAGATGGCAAGTTGTTACCTACTGAGTGGGGTTTCCTTTTCCCGCAAT | SEQ ID NO: 3389 | Homo sapiens KIAA1033 (KIAA1033), mRNA [NM_015275] |
| 336 | A_32_P155364 | RPL7 | TGAACAGGCTTATTAGAAAAATGAACGAAGGTGTCTACGCATGATTATTTTTCTAAGCTGG | SEQ ID NO: 3390 | Homo sapiens ribosomal protein L7 (RPL7), mRNA [NM_000971] |
| 337 | A_32_P158746 | RPL17 | TTTTGCTGCACATGCTAAAAATGCAGAGAGTAATGGTGAACTTAAGGGTTTAGATGTAG | SEQ ID NO: 3391 | Homo sapiens ribosomal protein L17 (RPL17), transcript variant 1, mRNA [NM_000985] |
| 338 | A_32_P164203 | THC2683448 | TTGATGGTCATTGTAGGAGGCTATTGTATGAATTACTGTGGAGTGCTGTTTACCACATGAT | SEQ ID NO: 3392 | Q7WZG3_PASP1 (Q7WZG3) Ferric uptake regulator, partial (8%) [THC2683448] |
| 339 | A_32_P166340 | SRP9 | ACATTGAAATATGTTTTGTATAAATTTGTCATGTTGAACAAGATTTTAGGATGGTAAGTT | SEQ ID NO: 3393 | Homo sapiens signal recognition particle 9kDa (SRP9), mRNA [NM_003133] |
| 340 | A_32_P170444 | SUB1 | TAGGTATCTCTCCTGAAATTCTTTGCAGTTCATTTTTTATGGCAGTTAATCCAGTGAAAC | SEQ ID NO: 3394 | Activated RNA polymerase II transcriptional coactivator p15 (SUB1 homolog) (Positive cofactor 4) (PC4) (p14). [Source:Uniprot/SWISSPROT:Acc:P53999] [ENST00000265073] |
| 341 | A_32_P1712 | RNASE2 | TCCAGGTGCGTTTAATGTACTGTAACCTCACAACTCGAAGTCGACAGAATATTTCAAACT | SEQ ID NO: 3395 | Homo sapiens ribonuclease, RNase A family, 2 (liver, eosinophil-derived neurotoxin) (RNASE2), mRNA [NM_002934] |
| 342 | A_32_P176619 | CMAH | GATTATATATGGTAGGTCTGATTCTGAAGATAGAAGAATTCAATGGTGGAATTTTGTCTCG | SEQ ID NO: 3396 | Homo sapiens cytidine monophosphate-N-acetylneuraminic acid hydroxylase (CMP-N-acetylneuraminate monooxygenase) (CMAH) on chromosome 6 [NR_002174] |
| 343 | A_32_P178966 | ENST00000379426 | GTAATATAGAGGGTGAAGTCTTTAGTGATACAGACAAGACAACTGTTAAAAAGTGAATCC | SEQ ID NO: 3397 | Novel protein. [Source:Uniprot/SPTREMBL:Acc:Q6T4T1] [ENST00000379426] |
| 344 | A_32_P184394 | TFEC | AGTTGCTTATGGCATACAAGAGGCTAAAATTAATTCAGGTATATTTAATCTTAATAATTATTAT | SEQ ID NO: 3398 | Homo sapiens transcription factor EC (TFEC), transcript variant 1, mRNA [NM_012252] |
| 345 | A_32_P190488 | hCG_26523 | CCCAGCAAGGTGGTTATGACTAGGCTAAAACTGGACAAAGACCGCAAAAGATGCTTGAA | SEQ ID NO: 3399 | PREDICTED: Homo sapiens similar to 60S ribosomal protein L26 (LOC646161), mRNA [XR_018048] |
| 346 | A_32_P193322 | RICTOR | ACCACATGAGTTTCTTCTTTTTTATTTAGTAATAGGCTGGTAGATATTTGGAGGTTCTGG | SEQ ID NO: 3400 | Homo sapiens rapamycin-insensitive companion of mTOR (RICTOR), mRNA [NM_152756] |

Fig. 24-19

| No. | Probe ID No. | Symbols of genes | Sequence | SEQ ID NO: | Descriptions of genes (letters and numbers within [ ] indicates GenBank accession No.) |
|---|---|---|---|---|---|
| 347 | A_32_P198483 | RPS3A | GGGGCGAAGAAGAAAGTGGTTGATGGATTTCTAAGAAGAGATTGGTATGATGTGAAAGCA | SEQ ID NO: 3401 | Homo sapiens ribosomal protein S3A (RPS3A), mRNA [NM_001006] |
| 348 | A_32_P197752 | FAM76B | TTGTGCTTTTAGCCTGTTTCCAACTAATAATTAGGATTTACCAGTAAGGGTCATTTTGAC | SEQ ID NO: 3402 | Homo sapiens family with sequence similarity 76, member B (FAM76B), mRNA [NM_144664] |
| 349 | A_32_P208178 | RPS3A | GGAAAAGACGTAGAAAAGGCTTGGCAATGCTATTTATCGTGTCGATGATGTCTTCGTTAGA | SEQ ID NO: 3403 | Homo sapiens ribosomal protein S3A (RPS3A), mRNA [NM_001006] |
| 350 | A_32_P224666 | CAPZA2 | AATGCTGTTTTGAGATCTGAAATTAAATGAAAATACTTATTTCAGAAATGCATTTAATG | SEQ ID NO: 3404 | Homo sapiens capping protein (actin filament) muscle Z-line, alpha 2 (CAPZA2), mRNA [NM_006136] |
| 351 | A_32_P22539 | hCG_28523 | ACTACGAAGGTCAGCAAATTGGCAAATTGGTCCAAGGTTTACAGGAAGAAATATGTTATCT | SEQ ID NO: 3405 | PREDICTED: Homo sapiens similar to 60S ribosomal protein L26 (Silica-induced gene 20 protein) (SIG-20) (LOC400055), mRNA [XM_374987] |
| 352 | A_32_P226786 | EC045174 | TTATTGGTGCATGTAAGGCATTATCCTGTCTTAATGAACGGATTAATGCTGTTGATTGTT | SEQ ID NO: 3406 | Homo sapiens cDNA clone IMAGE:5273245. [BC045174] |
| 353 | A_32_P2333 | SUB1 | AGGAAGAAAAGTATTTCTTTAAATGCAGAACAATGGAGGCCAGCTGACAGAACAGATTTC | SEQ ID NO: 3407 | Homo sapiens SUB1 homolog (S. cerevisiae) (SUB1), mRNA [NM_006713] |
| 354 | A_32_P4532 | LOC643932 | GATTCGAGACAGCATTGGAAAAAGACATAGAAAAAGGCTTGCCAATCTATCCTCTCCATGAT | SEQ ID NO: 3408 | PREDICTED: Homo sapiens similar to 40S ribosomal protein S3a (V-fos transformation effector protein) (LOC643932), mRNA [XR_017289] |
| 355 | A_32_P49164 | AV714556 | AAATGGAGAGCTTTGTTATTTGCCAAAGAAGAATTCATCATGTTCCTTCCTTTGTTTTCCC | SEQ ID NO: 3409 | AV714556 AV714556 DCB Homo sapiens cDNA clone DCBADG06 5', mRNA sequence [AV714556] |
| 356 | A_32_P49392 | A_32_P49392 | AATGCTGCCAAATCTGGAAGAAGATGATGGAAATCATGAGCCAAGAGGTGCAGAAATG | SEQ ID NO: 3410 | |
| 357 | A_32_P58074 | RPS3A | GTTGGTTTTACTAAAAAACGGCAAAATCAGATACGGAAGAACCTCTTATGCTCAGCACGAA | SEQ ID NO: 3411 | Homo sapiens ribosomal protein S3A (RPS3A), mRNA [NM_001006] |
| 358 | A_32_P66934 | BX641014 | AATGGCAGTTGCCACCATTCGTCGTAAAATGGCAGTTGTGTGAAGTTTATTTGTTAGAAA | SEQ ID NO: 3412 | Homo sapiens mRNA; cDNA DKFZp686l19109 (from clone DKFZp686l19109) [BX641014] |
| 359 | A_32_P88586 | ARL1 | TTGGGTTACCTGCCTTGAAGGACGGAAAATGGCAGATATTCAAAACGTGAGCAACGAAAG | SEQ ID NO: 3413 | Homo sapiens ADP-ribosylation factor-like 1 (ARL1), mRNA [NM_001177] |
| 360 | A_32_P7118 | PSMC6 | AGCAGACCTGAGAAATGTTTGTACTGAAGCAGGTATATCGCAATTCGTGCTGATCATGA | SEQ ID NO: 3414 | Homo sapiens proteasome (prosome, macropain) 26S subunit, ATPase, 6 (PSMC6), mRNA [NM_002806] |
| 361 | A_32_P73222 | AA631847 | TTTCTTTGTTTTGGACAATCTCATAAGAACTTTAGGTCTTACAGCACGAACCCGTCGAAG | SEQ ID NO: 3415 | np61b02.s1 NCI_CGAP_Br2 Homo sapiens cDNA clone IMAGE:1130763 3' similar to TR:G971838 G971838 60S RIBOSOMAL PROTEIN L34 ;, mRNA sequence [AA631847] |
| 362 | A_32_P93782 | RPL26 | AGGTGTGTAGATGGACAGTATAAAGGTCAGCAAATTGGCAAAGTAGTCGAGGTTTACAGGA | SEQ ID NO: 3416 | Homo sapiens ribosomal protein L26 (RPL26), mRNA [NM_000987] |
| 363 | A_32_P9362 | RP11-11C5.2 | AACAAGACGAGAAATATAATTGAGAAGGATCGTGTTTACAGAGGACTTGTTTAAAGTGT | SEQ ID NO: 3417 | Homo sapiens similar to RIKEN cDNA 2410129H14 (LOC440145), mRNA [NM_001071775] |

DETECTION OF DIGESTIVE ORGAN CANCER, GASTRIC CANCER, COLORECTAL CANCER, PANCREATIC CANCER, AND BILIARY TRACT CANCER BY GENE EXPRESSION PROFILING

CROSS-REFERENCE TO RELATED APPLICATIONS

This application is a 371 of PCT/JP2010/063122, filed Aug. 3, 2010, which claims the benefit of Japanese Patent Application No. 2009-193702, filed Aug. 24, 2009, the contents of each of which are incorporated herein by reference.

TECHNICAL FIELD

The present invention relates to detection and diagnosis of digestive organ cancer, gastric cancer, colorectal cancer, pancreatic cancer, and biliary tract cancer via gene expression analysis using peripheral blood as a material.

BACKGROUND ART

Digestive organ cancer is the most common form of malignant tumor among the Japanese. According to a survey by the Ministry of Health, Labour and Welfare, 177,000 patients die annually. Early detection and treatment can result in complete healing. The earlier the stage of the lesions, the fewer clinical symptoms are presented. Hence, some digestive organ cancer cases are detected in an advanced state, resulting in a poor prognostic outcome.

Gastric cancer is the most common form of digestive system malignant tumor among the Japanese. According to a survey by the Ministry of Health, Labour and Welfare, 50,000 patients die annually. Also, colorectal cancer is the form of digestive system malignant tumor that ranks $3^{rd}$ highest number in terms of deaths due to site-specific cancer (including both males and females) among the Japanese. According to a survey by the Ministry of Health, Labour and Welfare, 41,000 patients die annually. Both gastric cancer and colorectal cancer can be cured by early detection and treatment. The earlier the stage of the lesions, the fewer clinical symptoms are presented. Hence, some cases are detected in an advanced state, resulting in a poor prognostic outcome. Opportunities for early detection include many incidental detections by endoscopic examination and/or imaging studies upon examination and many detections during investigation of symptoms that are not directly associated with cancer. Currently, no hemodiagnosis marker useful for early detection of digestive organ cancer exists. It is extremely important to establish a system capable of diagnosing the presence of digestive organ cancer at as early a stage as possible.

In particular, pancreatic cancer is a form of digestive system malignant tumor that ranks the $5^{th}$ highest in terms of the number of deaths due to site-specific cancer (including both males and females) among the Japanese. According to a survey by the Ministry of Health, Labour and Welfare, 23,000 patients die annually. Cancer detection is very difficult and early cancer detection is rare. 75% of cases diagnosed with pancreatic cancer are already inoperable cases. Pancreatic cancer is a digestive organ cancer resulting in extremely poor prognosis such that the patients die within 1 to 2 years after detection (According a survey by the Center for Cancer Control and Information Services, National Cancer Center, http colon, forward slash, forward slash, gangojo, dot jp public, forward slash, cancer, forward slash, data forward slash, pancreas dot html). Although an advanced diagnostic technique for pancreatic cancer has long been desired, no useful early diagnosis method has been established.

Furthermore, biliary tract cancer is a form of malignant tumor that ranks $6^{th}$ highest in terms of the number of deaths due to site-specific cancer (including both males and females) among the Japanese. According to a survey by the Ministry of Health, Labour and Welfare, 15,000 patients die annually. In most cases, early detection is difficult because of the lack of subjective symptoms.

Recent development in DNA microarray techniques and human genome sequencing have enabled extensive gene expression analysis of all genes. Accordingly, new types of cancer diagnosis, prognostic prediction, prediction of recurrence rate after treatment, and the like have become possible. The present inventors have analyzed the pathological conditions of various diseases and developed for the purpose of developing a diagnostic tool through application of gene expression analysis such as analysis of gene expression profiles in chronic hepatitis patients (see non-patent documents 1 to 3) and gene expression analysis of liver tissue in diabetes mellitus patients. However, these forms of analysis are problematic in terms of their excessive invasiveness, and hospitalization and tissue (organ tissue such as liver tissue) sampling are required. Thereafter, a method requiring less invasiveness has been reported, wherein a gene group capable of distinguishing type C cirrhosis from type C liver cancer and peripheral blood mononuclear cells are used (see patent document 1 and non-patent document 4). This method is advantageous for patients because blood is used in this method and thus it offers a low degree of invasiveness for patients. However, the method is problematic in that collection of peripheral blood mononuclear cells requires several separation processes, the method is complicated as an actual test method, and the method requires much time for the test results to be obtained.

PRIOR ART DOCUMENTS

Patent Document

Patent document 1 JP Patent Publication (Kokai) No. 2008-126 A

Non-Patent Documents

Non-patent document 1 MASAO HONDA et al., GASTROENTEROLOGY 2001; 120:955-966

Non-patent document 2 MASAO HONDA et al., Am J Gastroenterol 2005; 100: 2019-2030

Non-patent document 3 YUKIHIRO SHIROTA et al., HEPATOLOGY Vol. 33, No. 4, 2001, 832-840

Non-patent document 4 YOSHIO SAKAI et al., Cancer Research; 68 (24) 2008. 10267-10279

DISCLOSURE OF THE INVENTION

Problem to be Solved by the Invention

An object of the present invention is to provide:

a method for detecting digestive organ cancer, gastric cancer, colorectal cancer, pancreatic cancer, and biliary tract cancer by analyzing genes with expression levels that vary in association with digestive organ cancer, gastric cancer, colorectal cancer, pancreatic cancer, and biliary tract cancer, whereby invasiveness to patients is low and genes can be easily extracted from patients; and an in vitro diagnostic.

Means for Solving the Problem

The present inventors have initiated clinical trials to verify if digestive organ cancer, gastric cancer, colorectal cancer, pancreatic cancer, and biliary tract cancer can be diagnosed by gene expression analysis using peripheral blood, and thus found that such diagnosis is possible.

Peripheral blood can be collected in a manner that requires a relatively low degree of invasiveness, and thus its practicality and usefulness in clinical examination are extremely high. Peripheral blood is composed of cell components including, in addition to erythrocytes and blood platelets, leukocytes containing lymphocytes, monocytes, and granulocytes. These cell components are thought to vary their phenotypes and functions depending on lesions in an in vivo environment.

The present inventors have conducted gene expression analysis of peripheral blood from 24 digestive organ cancer patients and 8 normal healthy subjects. Specifically, they have found that digestive organ cancer cases can be distinguished from normal healthy subjects by clustering analysis conducted using data from analysis with about 23,000 probes on DNA microarrays. Through comparison of the gene expression of a group of digestive organ cancer cases with that of a group of normal healthy subjects, 868 probes corresponding to genes with expression levels that differ significantly between the groups were found. With the use of the probe set, hierarchical clustering was performed for the above digestive organ cancer case group and the above normal healthy subject group, so that 2 clusters were formed. Thus the present inventors have found that the digestive organ cancer cases can be distinguished from the normal healthy subjects. Also, a prediction model was applied to 40 cancer cases and 13 normal healthy subject cases (differing from the cancer cases and the normal healthy subjects used for extraction of 868 probes), so that cancer cases and normal healthy subjects were determined. As a result, 39 out of 40 previously diagnosed cancer cases were determined to be actually cancer cases, and the probability that such cases had been properly diagnosed was 97.5%. Moreover, 9 out of 13 previously diagnosed normal healthy subject cases were determined to be normal healthy subject cases, and the probability that such cases had been properly diagnosed was 69.2%. The percentage of cases correctly determined was 90.6% ($^{48}/_{53}$).

Furthermore, the present inventors have conducted gene expression analysis of peripheral blood from 39 digestive organ cancer patients and peripheral blood from 15 normal healthy subjects. Specifically, they have found that digestive organ cancer cases can be distinguished from normal healthy subjects by clustering analysis conducted using data from analysis with about 23,000 probes on DNA microarrays. Through comparison of the gene expression of a group of digestive organ cancer cases with that of a group of normal healthy subjects, 25 probes corresponding to genes with expression levels that differ significantly between the groups were found. With the use of the probe set, hierarchical clustering was performed for the above digestive organ cancer case group and the above normal healthy subject group, so that 2 clusters were formed. Thus the present inventors have found that the digestive organ cancer cases can be distinguished from the normal healthy subjects.

As a result of the use of the above probes, the percentage of cases correctly determined was 92.3%.

Also, the present inventors have conducted gene expression analysis of peripheral blood from 8 gastric cancer patients and 8 normal healthy subjects. Specifically, they have found that gastric cancer cases can be distinguished from normal healthy subjects by clustering analysis conducted using data from analysis with about 22,000 probes on DNA microarrays. Through comparison of the gene expression of a group of gastric cancer cases with that of a group of normal healthy subjects, 713 probes corresponding to genes with expression levels that differ significantly between the groups were found. With the use of the probe set, hierarchical clustering was performed for the above gastric cancer case group and the above normal healthy subject group, so that 2 clusters were formed. Thus the present inventors have found that the gastric cancer cases can be distinguished from the normal healthy subjects. Also, a prediction model was applied to 10 cancer cases and 13 normal healthy subject cases (differing from the cancer cases and the normal healthy subjects used for extraction of 713 probes), so that cancer cases and normal healthy subjects were determined. As a result, 7 out of 10 previously diagnosed cancer cases were determined to be actually cancer cases, and the probability that such cases had been properly diagnosed was 70%. Moreover, 13 out of 13 previously diagnosed normal healthy subject cases were determined to be normal healthy subject cases, and the probability that such cases had been properly diagnosed was 100%. The percentage of cases correctly determined was 87.0% ($^{20}/_{23}$).

The present inventors have conducted gene expression analysis of peripheral blood from 8 colorectal cancer patients and 8 normal healthy subjects. Specifically, they have found that colorectal cancer cases can be distinguished from normal healthy subjects by clustering analysis conducted using data from analysis with about 22,000 probes on DNA microarrays. Through comparison of the gene expression of a group of colorectal cancer cases with that of a group of normal healthy subjects, 771 probes corresponding to genes with expression levels that differ significantly between the groups were found. With the use of the probe set, hierarchical clustering was performed for the above colorectal cancer case group and the above normal healthy subject group, so that 2 clusters were formed. Thus, colorectal cancer cases were distinguished from the normal healthy subjects. Also, a prediction model was applied to 10 cancer cases and 13 normal healthy subject cases (differing from the cancer cases and the normal healthy subjects used for extraction of 771 probes), so that cancer cases and normal healthy subjects are determined. As a result, 9 out of 10 previously diagnosed cancer cases were determined to be actually cancer cases, and the probability that such cases had been properly diagnosed was 90%. Moreover, 13 out of 13 previously diagnosed normal healthy subject cases were determined to be normal healthy subject cases, and the probability that such cases had been properly diagnosed was 100%. The percentage of cases correctly determined was 95.7% ($^{22}/_{23}$).

The present inventors have conducted gene expression analysis of peripheral blood from 8 pancreatic cancer patients and 8 normal healthy subjects. Specifically, they have found that pancreatic cancer cases can be distinguished from normal healthy subjects by clustering analysis conducted using data from analysis with about 22,000 probes on DNA microarrays. Through comparison of the gene expression of a group of pancreatic cancer cases with that of a group of normal healthy subjects, 677 probes corresponding to genes with expression levels that differ significantly between the groups were found. With the use of the probe set, hierarchical clustering was performed for the above pancreatic cancer case group and the above normal healthy subject group, so that 2 clusters were formed. Thus the present inventors have found that pancreatic cancer cases can be distinguished from the normal healthy subjects. Also, a prediction model was applied to 20 cancer cases and 13 normal healthy subject cases (differing from the cancer cases and the normal healthy subjects used for extraction of 677 probes), so that cancer cases and normal healthy subjects were determined. As a result, 15 out of 20 previously diagnosed cancer cases were determined to be actually cancer cases, and the probability that such cases had been properly diagnosed was 75%. Moreover, 13 out of 13 previously diagnosed normal healthy subject cases were determined to be normal healthy subject cases, and the probability that such cases had been properly diagnosed was 100%. The percentage of cases correctly determined was 84.8% (28/33).

The present inventors have conducted gene expression analysis of peripheral blood from 8 biliary tract cancer patients and 8 normal healthy subjects. Specifically, they have found that biliary tract cancer cases can be distinguished from normal healthy subjects by clustering analysis conducted (to form 3 clusters) using data from analysis with about 22,000 probes on DNA microarrays. Through comparison of the gene expression of a group of biliary tract cancer cases with that of a group of normal healthy subjects, 363 probes corresponding to genes with expression levels that differ significantly between the groups were found. With the use of the probe set, hierarchical clustering was performed for the above biliary tract cancer case group and the above normal healthy subject group, so that 2 clusters were formed. Thus the present inventors have found that the biliary tract cancer cases can be distinguished from the normal healthy subjects. Also, a prediction model was applied to 8 cancer cases and 13 normal healthy subject cases (differing from the cancer cases and the normal healthy subjects used for extraction of 363 probes), so that cancer cases and normal healthy subjects were determined. As a result, 8 out of 8 previously diagnosed cancer cases were determined to be actually cancer cases, and the probability that such cases had been properly diagnosed was 100%. Moreover, 13 out of 13 previously diagnosed normal healthy subject cases were determined to be normal healthy subject cases, and the probability that such cases had been properly diagnosed was 100%. The percentage of cases correctly determined was 100% (21/21).

Based on these results, it was found that examination of changes in expression of the gene set in peripheral blood enables diagnosis of digestive organ cancer, gastric cancer, colorectal cancer, pancreatic cancer, and biliary tract cancer. Thus, the present invention was completed. The method of the present invention enables preparation of a new practical diagnostic kit for diagnosis of digestive organ cancer by applying a DNA microarray developmental technique, a real-time PCR method, and an ELISA method.

Currently, general tumor markers covered by health insurance are not always useful for all digestive organ cancer patients. However, the detection sensitivity of the gene expression analysis of the present invention is 90.6%, allowing digestive organ cancer to be specified with very high detection sensitivity through convenient blood collection. Specifically, the present invention is as follows.

[1] A reagent for detecting digestive organ cancer by measuring the expression of genes corresponding to probes consisting of nucleotide sequences shown in SEQ ID NO: 220, 506, 508, 523, 538, 554, 570, 589, 597, 602, 618, 654, 689, 701, 726, 744, 762, 763, 781, 795, and 849 in peripheral blood, wherein the reagent contains all probes consisting of the nucleotide sequences shown in SEQ ID NOs: 220, 506, 508, 523, 538, 554, 570, 589, 597, 602, 618, 654, 689, 701, 726, 744, 762, 763, 781, 795, and 849; or a reagent for detecting digestive organ cancer by measuring the expression of genes corresponding to probes consisting of the nucleotide sequences shown in SEQ ID NOs: 3030 to 3054 in peripheral blood, wherein the reagent contains all probes consisting of the nucleotide sequences shown in SEQ ID NOs: 3030 to 3054.

[2] The reagent for detecting digestive organ cancer according to [1], containing a DNA microarray in which the probes of [1] bind to a substrate.

[3] A method for detecting digestive organ cancer, comprising obtaining the gene expression profiles of all genes corresponding to probes consisting of the nucleotide sequences shown in SEQ ID NOs: 220, 506, 508, 523, 538, 554, 570, 589, 597, 602, 618, 654, 689, 701, 726, 744, 762, 763, 781, 795, and 849 in peripheral blood from a subject, or all genes corresponding to probes consisting of the nucleotide sequences shown in SEQ ID NOs: 3030 to 3054 in peripheral blood from a subject and then detecting digestive organ cancer based on the expression profiles.

[4] A reagent for detecting gastric cancer by measuring the expression of genes corresponding to probes consisting of the nucleotide sequences shown in SEQ ID NOs: 923, 927, 929, 932, 946, 952, 986, 998, 1000, 1006, 1007, 1013, 1019, 1020, 1022, 1027, 1039, 1046, 1073, 1090, 1107, 1108, 1117, 1121, 1132, 1134, 1154, 1162, 1179, 1183, 1191, 1205, 1207, 1211, 1216, 1217, 1224, 1239, 1244, 1251, 1254, 1255, 1283, 1285, 1301, 1304, 1316, 1317, 1327, 1328, 1331, 1332, 1345, 1359, 1365, 1366, 1372, 1373, 1375, 1379, 1380, 1382, 1383, 1393, 1394, 1396, 1397, 1404, 1405, 1406, 1407, 1421, 1423, 1426, 1430, 1440, 1441, 1442, 1448, 1450, 1454, 1455, 1456, 1459, 1466, 1467, 1491, 1497, 1500, 1502, 1504, 1508, 1513, 1514, 1519, 1531, 1534, 1544, 1546, 1549, 1551, 1560, 1563, 1566, 1570, 1571, and 1578 in peripheral blood, wherein the reagent contains all probes consisting of the nucleotide sequences shown in SEQ ID NO: 923, 927, 929, 932, 946, 952, 986, 998, 1000, 1006, 1007, 1013, 1019, 1020, 1022, 1027, 1039, 1046, 1073, 1090, 1107, 1108, 1117, 1121, 1132, 1134, 1154, 1162, 1179, 1183, 1191, 1205, 1207, 1211, 1216, 1217, 1224, 1239, 1244, 1251, 1254, 1255, 1283, 1285, 1301, 1304, 1316, 1317, 1327, 1328, 1331, 1332, 1345, 1359, 1365, 1366, 1372, 1373, 1375, 1379, 1380, 1382, 1383, 1393, 1394, 1396, 1397, 1404, 1405, 1406, 1407, 1421, 1423, 1426, 1430, 1440, 1441, 1442, 1448, 1450, 1454, 1455, 1456, 1459, 1466, 1467, 1491, 1497, 1500, 1502, 1504, 1508, 1513, 1514, 1519, 1531, 1534, 1544, 1546, 1549, 1551, 1560, 1563, 1566, 1570, 1571, and 1578.

[5] The reagent for detecting gastric cancer according to [4], containing a DNA microarray in which the probes of [4] bind to a substrate.

[6] A method for detecting gastric cancer, comprising obtaining the gene expression profiles of all genes corresponding to probes consisting of the nucleotide sequences shown in SEQ ID NOs: 923, 927, 929, 932, 946, 952, 986, 998, 1000, 1006, 1007, 1013, 1019, 1020, 1022, 1027, 1039, 1046, 1073, 1090, 1107, 1108, 1117, 1121, 1132, 1134, 1154, 1162, 1179, 1183, 1191, 1205, 1207, 1211, 1216, 1217, 1224, 1239, 1244, 1251, 1254, 1255, 1283, 1285, 1301, 1304, 1316, 1317, 1327, 1328, 1331, 1332, 1345, 1359, 1365, 1366, 1372, 1373, 1375, 1379, 1380, 1382, 1383, 1393, 1394, 1396, 1397, 1404, 1405, 1406, 1407, 1421, 1423, 1426, 1430, 1440, 1441, 1442, 1448, 1450, 1454, 1455, 1456, 1459, 1466, 1467, 1491, 1497, 1500, 1502, 1504, 1508, 1513, 1514, 1519, 1531, 1534, 1544, 1546, 1549, 1551, 1560, 1563, 1566, 1570, 1571, and 1578 in peripheral blood from a subject and then detecting gastric cancer based on the expression profiles.

[7] A reagent for detecting colorectal cancer by measuring the expression of genes corresponding to probes consisting of the nucleotide sequences shown in SEQ ID NOs: 1583, 1601, 1611, 1614, 1644, 1651, 1678, 1680, 1684, 1737, 1746, 1750, 1751, 1757, 1760, 1765, 1766, 1773, 1778, 1779, 1780, 1782, 1787, 1794, 1795, 1798, 1802, 1831, 1836, 1837, 1853, 1854, 1869, 1871, 1873, 1876, 1880, 1890, 1892, 1896, 1925, 1942, 1950, 1953, 1962, 1970, 1977, 1978, 1985, 1990, 1991, 2000, 2004, 2007, 2011, 2018, 2019, 2023, 2032, 2046, 2050, 2054, 2077, 2085, 2088, 2095, 2105, 2126, 2128, 2132, 2138, 2140, 2143, 2144, 2145, 2147, 2158, 2160, 2161, 2173, 2175, 2176, 2180, 2191, 2193, 2198, 2207, 2209, 2213, 2217, 2218, 2223, 2227, 2233, 2247, 2255, 2257, 2258, 2261, 2266, 2268, 2269, 2273, 2280, 2286, 2296, 2306, 2317, 2320, 2322, 2325, 2332, 2334, 2336, 2339, and 2340, wherein the reagent contains all probes consisting of the nucleotide sequences shown in SEQ ID NOs: 1583, 1601, 1611, 1614, 1644, 1651, 1678, 1680, 1684, 1737, 1746, 1750, 1751, 1757, 1760, 1765, 1766, 1773, 1778, 1779, 1780, 1782, 1787, 1794, 1795, 1798, 1802, 1831, 1836, 1837, 1853, 1854, 1869, 1871, 1873, 1876, 1880, 1890, 1892, 1896, 1925, 1942, 1950, 1953, 1962, 1970, 1977, 1978, 1985, 1990, 1991, 2000, 2004, 2007, 2011, 2018, 2019, 2023, 2032, 2046, 2050, 2054, 2077, 2085, 2088, 2095, 2105, 2126, 2128, 2132, 2138, 2140, 2143, 2144, 2145, 2147, 2158, 2160, 2161, 2173, 2175, 2176, 2180, 2191, 2193, 2198, 2207, 2209, 2213, 2217, 2218, 2223, 2227, 2233, 2247, 2255, 2257, 2258, 2261, 2266, 2268, 2269, 2273, 2280, 2286, 2296, 2306, 2317, 2320, 2322, 2325, 2332, 2334, 2336, 2339, and 2340.

[8] The reagent for detecting colorectal cancer according to [7], containing a DNA microarray in which the probes of [7] bind to a substrate.

[9] A method for detecting colorectal cancer, comprising obtaining the gene expression profiles of all genes corresponding to probes consisting of the nucleotide sequences shown in SEQ ID NOs: 1583, 1601, 1611, 1614, 1644, 1651, 1678, 1680, 1684, 1737, 1746, 1750, 1751, 1757, 1760, 1765, 1766, 1773, 1778, 1779, 1780, 1782, 1787, 1794, 1795, 1798, 1802, 1831, 1836, 1837, 1853, 1854, 1869, 1871, 1873, 1876, 1880, 1890, 1892, 1896, 1925, 1942, 1950, 1953, 1962, 1970, 1977, 1978, 1985, 1990, 1991, 2000, 2004, 2007, 2011, 2018, 2019, 2023, 2032, 2046, 2050, 2054, 2077, 2085, 2088, 2095, 2105, 2126, 2128, 2132, 2138, 2140, 2143, 2144, 2145, 2147, 2158, 2160, 2161, 2173, 2175, 2176, 2180, 2191, 2193, 2198, 2207, 2209, 2213, 2217, 2218, 2223, 2227, 2233, 2247, 2255, 2257, 2258, 2261, 2266, 2268, 2269, 2273, 2280, 2286, 2296, 2306, 2317, 2320, 2322, 2325, 2332, 2334, 2336, 2339, and 2340 in peripheral blood from a subject and then detecting colorectal cancer based on the gene expression profiles.

[10] A reagent for detecting pancreatic cancer by measuring the expression of genes corresponding to probes consisting of the nucleotide sequences shown in SEQ ID NOs: 2373, 2404, 2418, 2419, 2426, 2430, 2459, 2461, 2469, 2475, 2507, 2514, 2515, 2525, 2543, 2600, 2602, 2621, 2628, 2634, 2640, 2651, 2652, 2674, 2677, 2680, 2681, 2691, 2692, 2700, 2714, 2715, 2719, 2723, 2724, 2738, 2740, 2746, 2748, 2763, 2778, 2781, 2815, 2818, 2823, 2842, 2857, 2861, 2885, 2898, 2902, 2903, 2932, 2934, 2972, 2975, 2982, 2985, 2999, 3001, and 3003, wherein the reagent contains all probes consisting of the nucleotide sequences shown in SEQ ID NO: 2373, 2404, 2418, 2419, 2426, 2430, 2459, 2461, 2469, 2475, 2507, 2514, 2515, 2525, 2543, 2600, 2602, 2621, 2628, 2634, 2640, 2651, 2652, 2674, 2677, 2680, 2681, 2691, 2692, 2700, 2714, 2715, 2719, 2723, 2724, 2738, 2740, 2746, 2748, 2763, 2778, 2781, 2815, 2818, 2823, 2842, 2857, 2861, 2885, 2898, 2902, 2903, 2932, 2934, 2972, 2975, 2982, 2985, 2999, 3001, and 3003.

[11] The reagent for detecting pancreatic cancer according to [10], containing a DNA microarray in which the probes of [10] bind to a substrate.

[12] A method for detecting pancreatic cancer, comprising obtaining the gene expression profiles of all genes corresponding to probes consisting of the nucleotide sequences shown in SEQ ID NOs: 2373, 2404, 2418, 2419, 2426, 2430, 2459, 2461, 2469, 2475, 2507, 2514, 2515, 2525, 2543, 2600, 2602, 2621, 2628, 2634, 2640, 2651, 2652, 2674, 2677, 2680, 2681, 2691, 2692, 2700, 2714, 2715, 2719, 2723, 2724, 2738, 2740, 2746, 2748, 2763, 2778, 2781, 2815, 2818, 2823, 2842, 2857, 2861, 2885, 2898, 2902, 2903, 2932, 2934, 2972, 2975, 2982, 2985, 2999, 3001, and 3003 in peripheral blood from a subject and detecting pancreatic cancer based on the expression profiles.

[13] A reagent for detecting biliary tract cancer by measuring the expression of genes corresponding to probes consisting of the nucleotide sequences shown in SEQ ID NOs: 3055 to 3417, which contains all probes consisting of the nucleotide sequences shown in SEQ ID NOs: 3055 to 3417.

[14] The reagent for detecting biliary tract cancer according to [13], containing a DNA microarray in which the probes of [13] bind to a substrate.

[15] A method for detecting biliary tract cancer, comprising obtaining the gene expression profiles of all genes corresponding to probes consisting of the nucleotide sequences shown in SEQ ID NOs: 3055 to 3417 in peripheral blood from a subject, and then detecting biliary tract cancer based on the expression profiles.

This description includes the disclosure of the description and drawings of Japanese Patent Application No. 2009-193702, from which the present application claims priority.

Effects of the Invention

The expression levels of the genes corresponding to the probes of the present invention vary among digestive organ cancer, gastric cancer, colorectal cancer, pancreatic cancer, and biliary tract cancer. Through analysis of the expression profiles of these genes, digestive organ cancer, gastric cancer, colorectal cancer, pancreatic cancer, or biliary tract cancer can be detected. Furthermore, a risk of developing digestive organ cancer, gastric cancer, colorectal cancer, pancreatic cancer, or biliary tract cancer can be predicted, for example.

BRIEF DESCRIPTION OF THE DRAWINGS

FIG. 1-1 shows 868 probes of a $1^{st}$ probe group that can be used for detection of digestive organ cancer.

FIG. 1-2 shows 868 probes that can be used for detection of digestive organ cancer (continuation).

FIG. 1-3 shows 868 probes that can be used for detection of digestive organ cancer (continuation).

FIG. 1-4 shows 868 probes that can be used for detection of digestive organ cancer (continuation).

FIG. 1-5 shows 868 probes that can be used for detection of digestive organ cancer (continuation).

FIG. 1-6 shows 868 probes that can be used for detection of digestive organ cancer (continuation).

FIG. 1-7 shows 868 probes that can be used for detection of digestive organ cancer (continuation).

FIG. 1-8 shows 868 probes that can be used for detection of digestive organ cancer (continuation).

FIG. 1-9 shows 868 probes that can be used for detection of digestive organ cancer (continuation).

FIG. 1-10 shows 868 probes that can be used for detection of digestive organ cancer (continuation).

FIG. 1-11 shows 868 probes that can be used for detection of digestive organ cancer (continuation).

FIG. 1-12 shows 868 probes that can be used for detection of digestive organ cancer (continuation).

FIG. 1-13 shows 868 probes that can be used for detection of digestive organ cancer (continuation).

FIG. 1-14 shows 868 probes that can be used for detection of digestive organ cancer (continuation).

FIG. 1-15 shows 868 probes that can be used for detection of digestive organ cancer (continuation).

FIG. 1-16 shows 868 probes that can be used for detection of digestive organ cancer (continuation).

FIG. 1-17 shows 868 probes that can be used for detection of digestive organ cancer (continuation).

FIG. 1-18 shows 868 probes that can be used for detection of digestive organ cancer (continuation).

FIG. 1-19 shows 868 probes that can be used for detection of digestive organ cancer (continuation).

FIG. 1-20 shows 868 probes that can be used for detection of digestive organ cancer (continuation).

FIG. 1-21 shows 868 probes that can be used for detection of digestive organ cancer (continuation).

FIG. 1-22 shows 868 probes that can be used for detection of digestive organ cancer (continuation).

FIG. 1-23 shows 868 probes that can be used for detection of digestive organ cancer (continuation).

FIG. 1-24 shows 868 probes that can be used for detection of digestive organ cancer (continuation).

FIG. 1-25 shows 868 probes that can be used for detection of digestive organ cancer (continuation).

FIG. 1-26 shows 868 probes that can be used for detection of digestive organ cancer (continuation).

FIG. 1-27 shows 868 probes that can be used for detection of digestive organ cancer (continuation).

FIG. 1-28 shows 868 probes that can be used for detection of digestive organ cancer (continuation).

FIG. 1-29 shows 8.68 probes that can be used for detection of digestive organ cancer (continuation).

FIG. 1-30 shows 868 probes that can be used for detection of digestive organ cancer (continuation).

FIG. 1-31 shows 868 probes that can be used for detection of digestive organ cancer (continuation).

FIG. 1-32 shows 868 probes that can be used for detection of digestive organ cancer (continuation).

FIG. 1-33 shows 868 probes that can be used for detection of digestive organ cancer (continuation).

FIG. 1-34 shows 868 probes that can be used for detection of digestive organ cancer (continuation).

FIG. 1-35 shows 868 probes that can be used for detection of digestive organ cancer (continuation).

FIG. 1-36 shows 868 probes that can be used for detection of digestive organ cancer (continuation).

FIG. 1-37 shows 868 probes that can be used for detection of digestive organ cancer (continuation).

FIG. 1-38 shows 868 probes that can be used for detection of digestive organ cancer (continuation).

FIG. 1-39 shows 868 probes that can be used for detection of digestive organ cancer (continuation).

FIG. 1-40 shows 868 probes that can be used for detection of digestive organ cancer (continuation).

FIG. 1-41 shows 868 probes that can be used for detection of digestive organ cancer (continuation).

FIG. 1-42 shows 868 probes that can be used for detection of digestive organ cancer (continuation).

FIG. 1-43 shows 868 probes that can be used for detection of digestive organ cancer (continuation).

FIG. 1-44 shows 868 probes that can be used for detection of digestive organ cancer (continuation).

FIG. 1-45 shows 868 probes that can be used for detection of digestive organ cancer (continuation).

FIG. 1-46 shows 868 probes that can be used for detection of digestive organ cancer (continuation).

FIG. 1-47 shows 868 probes that can be used for detection of digestive organ cancer (continuation).

FIG. 1-48 shows 868 probes that can be used for detection of digestive organ cancer (continuation).

FIG. 2 shows 21 probes with expression levels that differed, significantly particularly between digestive organ cancer patients and normal healthy subjects, from among the 868 probes shown in FIG. 1.

FIG. 3-1 shows 713 probes that can be used for detection of gastric cancer.

FIG. 3-2 shows 713 probes that can be used for detection of gastric cancer (continuation).

FIG. 3-3 shows 713 probes that can be used for detection of gastric cancer (continuation).

FIG. 3-4 shows 713 probes that can be used for detection of gastric cancer (continuation).

FIG. 3-5 shows 713 probes that can be used for detection of gastric cancer (continuation).

FIG. 3-6 shows 713 probes that can be used for detection of gastric cancer (continuation).

FIG. 3-7 shows 713 probes that can be used for detection of gastric cancer (continuation).

FIG. 3-8 shows 713 probes that can be used for detection of gastric cancer (continuation).

FIG. 3-9 shows 713 probes that can be used for detection of gastric cancer (continuation).

FIG. 3-10 shows 713 probes that can be used for detection of gastric cancer (continuation).

FIG. 3-11 shows 713 probes that can be used for detection of gastric cancer (continuation).

FIG. 3-12 shows 713 probes that can be used for detection of gastric cancer (continuation).

FIG. 3-13 shows 713 probes that can be used for detection of gastric cancer (continuation).

FIG. 3-14 shows 713 probes that can be used for detection of gastric cancer (continuation).

FIG. 3-15 shows 713 probes that can be used for detection of gastric cancer (continuation).

FIG. 3-16 shows 713 probes that can be used for detection of gastric cancer (continuation).

FIG. 3-17 shows 713 probes that can be used for detection of gastric cancer (continuation).

FIG. 3-18 shows 713 probes that can be used for detection of gastric cancer (continuation).

FIG. 3-19 shows 713 probes that can be used for detection of gastric cancer (continuation).

FIG. 3-20 shows 713 probes that can be used for detection of gastric cancer (continuation).

FIG. 3-21 shows 713 probes that can be used for detection of gastric cancer (continuation).

FIG. 3-22 shows 713 probes that can be used for detection of gastric cancer (continuation).

FIG. 3-23 shows 713 probes that can be used for detection of gastric cancer (continuation).

FIG. 3-24 shows 713 probes that can be used for detection of gastric cancer (continuation).

FIG. 3-25 shows 713 probes that can be used for detection of gastric cancer (continuation).

FIG. 3-26 shows 713 probes that can be used for detection of gastric cancer (continuation).

FIG. 3-27 shows 713 probes that can be used for detection of gastric cancer (continuation).

FIG. 3-28 shows 713 probes that can be used for detection of gastric cancer (continuation).

FIG. 3-29 shows 713 probes that can be used for detection of gastric cancer (continuation).

FIG. 3-30 shows 713 probes that can be used for detection of gastric cancer (continuation).

FIG. 3-31 shows 713 probes that can be used for detection of gastric cancer (continuation).

FIG. 3-32 shows 713 probes that can be used for detection of gastric cancer (continuation).

FIG. 3-33 shows 713 probes that can be used for detection of gastric cancer (continuation).

FIG. 3-34 shows 713 probes that can be used for detection of gastric cancer (continuation).

FIG. 3-35 shows 713 probes that can be used for detection of gastric cancer (continuation).

FIG. 3-36 shows 713 probes that can be used for detection of gastric cancer (continuation).

FIG. 3-37 shows 713 probes that can be used for detection of gastric cancer (continuation).

FIG. 3-38 shows 713 probes that can be used for detection of gastric cancer (continuation).

FIG. 3-39 shows 713 probes that can be used for detection of gastric cancer (continuation).

FIG. 4-1 shows 107 probes with expression levels that differed significantly particularly between gastric cancer patients and normal healthy subjects, from among 713 probes shown in FIG. 3.

FIG. 4-2 shows 107 probes with expression levels that differed significantly particularly between gastric cancer patients and normal healthy subjects, from among the 713 probes shown in FIG. 3 (continuation).

FIG. 4-3 shows 107 probes with expression levels that differed significantly particularly between gastric cancer patients and normal healthy subjects, from among the 713 probes shown in FIG. 3 (continuation).

FIG. 4-4 shows 107 probes with expression levels that differed significantly particularly between gastric cancer patients and normal healthy subjects, from among the 713 probes shown in FIG. 3 (continuation).

FIG. 4-5 shows 107 probes with expression levels that differed significantly particularly between gastric cancer patients and normal healthy subjects, from among the 713 probes shown in FIG. 3 (continuation).

FIG. 4-6 shows 107 probes with expression levels that differed significantly particularly between gastric cancer patients and normal healthy subjects, from among the 713 probes shown in FIG. 3 (continuation).

FIG. 5-1 shows 771 probes that can be used for detection of colorectal cancer.

FIG. 5-2 shows 771 probes that can be used for detection of colorectal cancer (continuation).

FIG. 5-3 shows 771 probes that can be used for detection of colorectal cancer (continuation).

FIG. 5-4 shows 771 probes that can be used for detection of colorectal cancer (continuation).

FIG. 5-5 shows 771 probes that can be used for detection of colorectal cancer (continuation).

FIG. 5-6 shows 771 probes that can be used for detection of colorectal cancer (continuation).

FIG. 5-7 shows 771 probes that can be used for detection of colorectal cancer (continuation).

FIG. 5-8 shows 771 probes that can be used for detection of colorectal cancer (continuation).

FIG. 5-9 shows 771 probes that can be used for detection of colorectal cancer (continuation).

FIG. 5-10 shows 771 probes that can be used for detection of colorectal cancer (continuation).

FIG. 5-11 shows 771 probes that can be used for detection of colorectal cancer (continuation).

FIG. 5-12 shows 771 probes that can be used for detection of colorectal cancer (continuation).

FIG. 5-13 shows 771 probes that can be used for detection of colorectal cancer (continuation).

FIG. 5-14 shows 771 probes that can be used for detection of colorectal cancer (continuation).

FIG. 5-15 shows 771 probes that can be used for detection of colorectal cancer (continuation).

FIG. 5-16 shows 771 probes that can be used for detection of colorectal cancer (continuation).

FIG. 5-17 shows 771 probes that can be used for detection of colorectal cancer (continuation).

FIG. 5-18 shows 771 probes that can be used for detection of colorectal cancer (continuation).

FIG. 5-19 shows 771 probes that can be used for detection of colorectal cancer (continuation).

FIG. 5-20 shows 771 probes that can be used for detection of colorectal cancer (continuation).

FIG. 5-21 shows 771 probes that can be used for detection of colorectal cancer (continuation).

FIG. 5-22 shows 771 probes that can be used for detection of colorectal cancer (continuation).

FIG. 5-23 shows 771 probes that can be used for detection of colorectal cancer (continuation).

FIG. 5-24 shows 771 probes that can be used for detection of colorectal cancer (continuation).

FIG. 5-25 shows 771 probes that can be used for detection of colorectal cancer (continuation).

FIG. 5-26 shows 771 probes that can be used for detection of colorectal cancer (continuation).

FIG. 5-27 shows 771 probes that can be used for detection of colorectal cancer (continuation).

FIG. 5-28 shows 771 probes that can be used for detection of colorectal cancer (continuation).

FIG. 5-29 shows 771 probes that can be used for detection of colorectal cancer (continuation).

FIG. 5-30 shows 771 probes that can be used for detection of colorectal cancer (continuation).

FIG. 5-31 shows 771 probes that can be used for detection of colorectal cancer (continuation).

FIG. 5-32 shows 771 probes that can be used for detection of colorectal cancer (continuation).

FIG. 5-33 shows 771 probes that can be used for detection of colorectal cancer (continuation).

FIG. 5-34 shows 771 probes that can be used for detection of colorectal cancer (continuation).

FIG. 5-35 shows 771 probes that can be used for detection of colorectal cancer (continuation).

FIG. 5-36 shows 771 probes that can be used for detection of colorectal cancer (continuation).

FIG. 5-37 shows 771 probes that can be used for detection of colorectal cancer (continuation).

FIG. 5-38 shows 771 probes that can be used for detection of colorectal cancer (continuation).

FIG. 5-39 shows 771 probes that can be used for detection of colorectal cancer (continuation).

FIG. 5-40 shows 771 probes that can be used for detection of colorectal cancer (continuation).

FIG. 5-41 shows 771 probes that can be used for detection of colorectal cancer (continuation).

FIG. 6-1 shows 116 probes with expression levels that differed significantly particularly between colorectal cancer patients and normal healthy subjects, from among the 771 probes shown in FIG. 5.

FIG. 6-2 shows 116 probes with expression levels that differed significantly particularly between colorectal cancer patients and normal healthy subjects, from among the 771 probes shown in FIG. 5 (continuation).

FIG. 6-3 shows 116 probes with expression levels that differed significantly particularly between colorectal cancer patients and normal healthy subjects, from among the 771 probes shown in FIG. 5 (continuation).

FIG. 6-4 shows 116 probes with expression levels differed significantly particularly between colorectal cancer patients and normal healthy subjects, from among the 771 probes shown in FIG. 5 (continuation).

FIG. 6-5 shows 116 probes with expression levels differed significantly particularly between colorectal cancer patients and normal healthy subjects, from among the 771 probes shown in FIG. 5 (continuation).

FIG. 6-6 shows 116 probes with expression levels differed significantly particularly between colorectal cancer patients and normal healthy subjects, from among the 771 probes shown in FIG. 5 (continuation).

FIG. 6-7 shows 116 probes with expression levels differed significantly particularly between colorectal cancer patients and normal healthy subjects, from among the 771 probes shown in FIG. 5 (continuation).

FIG. 7-1 shows 677 probes that can be used for detection of pancreatic cancer.

FIG. 7-2 shows 677 probes that can be used for detection of pancreatic cancer (continuation).

FIG. 7-3 shows 677 probes that can be used for detection of pancreatic cancer (continuation).

FIG. 7-4 shows 677 probes that can be used for detection of pancreatic cancer (continuation).

FIG. 7-5 shows 677 probes that can be used for detection of pancreatic cancer (continuation).

FIG. 7-6 shows 677 probes that can be used for detection of pancreatic cancer (continuation).

FIG. 7-7 shows 677 probes that can be used for detection of pancreatic cancer (continuation).

FIG. 7-8 shows 677 probes that can be used for detection of pancreatic cancer (continuation).

Figure 9:
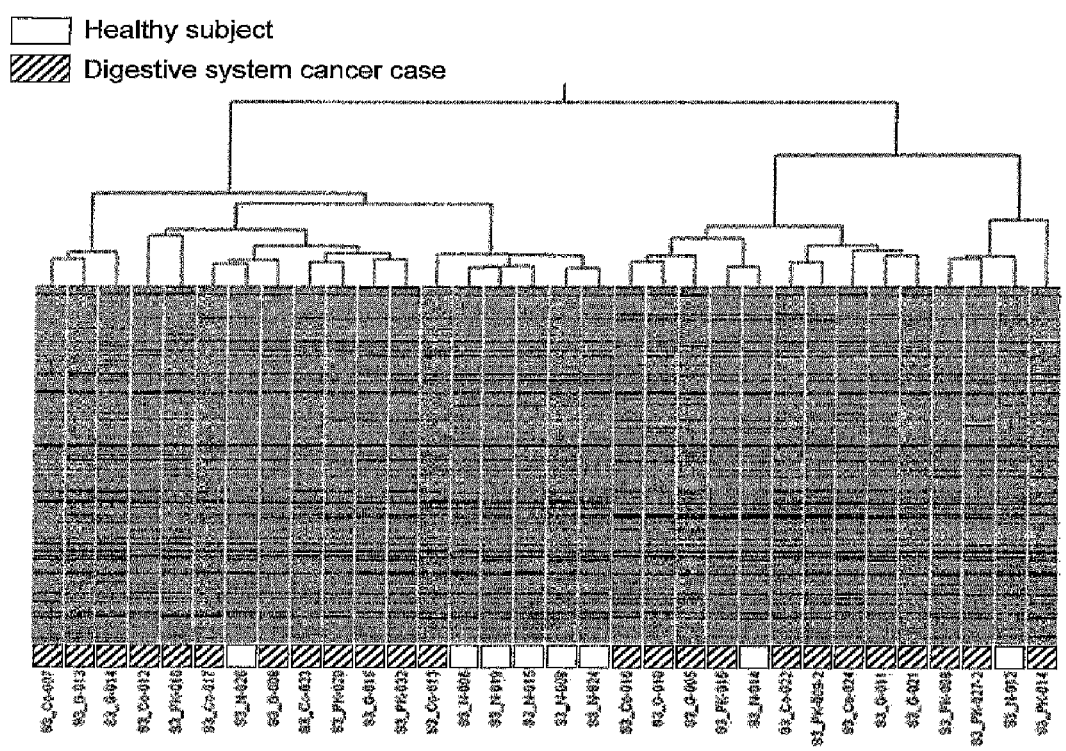

FIG. 7-9 shows 677 probes that can be used for detection of pancreatic cancer (continuation).

FIG. 7-10 shows 677 probes that can be used for detection of pancreatic cancer (continuation).

FIG. 7-11 shows 677 probes that can be used for detection of pancreatic cancer (continuation).

FIG. 7-12 shows 677 probes that can be used for detection of pancreatic cancer (continuation).

FIG. 7-13 shows 677 probes that can be used for detection of pancreatic cancer (continuation).

FIG. 7-14 shows 677 probes that can be used for detection of pancreatic cancer (continuation).

FIG. 7-15 shows 677 probes that can be used for detection of pancreatic cancer (continuation).

FIG. 7-16 shows 677 probes that can be used for detection of pancreatic cancer (continuation).

FIG. 7-17 shows 677 probes that can be used for detection of pancreatic cancer (continuation).

FIG. 7-18 shows 677 probes that can be used for detection of pancreatic cancer (continuation).

FIG. 7-19 shows 677 probes that can be used for detection of pancreatic cancer (continuation).

FIG. 7-20 shows 677 probes that can be used for detection of pancreatic cancer (continuation).

FIG. 7-21 shows 677 probes that can be used for detection of pancreatic cancer (continuation).

FIG. 7-22 shows 677 probes that can be used for detection of pancreatic cancer (continuation).

FIG. 7-23 shows 677 probes that can be used for detection of pancreatic cancer (continuation).

FIG. 7-24 shows 677 probes that can be used for detection of pancreatic cancer (continuation).

FIG. 7-25 shows 677 probes that can be used for detection of pancreatic cancer (continuation).

FIG. 7-26 shows 677 probes that can be used for detection of pancreatic cancer (continuation).

FIG. 7-27 shows 677 probes that can be used for detection of pancreatic cancer (continuation).

FIG. 7-28 shows 677 probes that can be used for detection of pancreatic cancer (continuation).

FIG. 7-29 shows 677 probes that can be used for detection of pancreatic cancer (continuation).

FIG. 7-30 shows 677 probes that can be used for detection of pancreatic cancer (continuation).

FIG. 7-31 shows 677 probes that can be used for detection of pancreatic cancer (continuation).

FIG. 7-32 shows 677 probes that can be used for detection of pancreatic cancer (continuation).

FIG. 7-33 shows 677 probes that can be used for detection of pancreatic cancer (continuation).

FIG. 7-34 shows 677 probes that can be used for detection of pancreatic cancer (continuation).

FIG. 7-35 shows 677 probes that can be used for detection of pancreatic cancer (continuation).

FIG. 7-36 shows 677 probes that can be used for detection of pancreatic cancer (continuation).

FIG. 7-37 shows 677 probes that can be used for detection of pancreatic cancer (continuation).

FIG. 8-1 shows 61 probes with expression levels that differed significantly particularly between pancreatic cancer patients and normal healthy subjects, from among the 677 probes shown in FIG. 7.

FIG. 8-2 shows 61 probes with expression levels that differed significantly particularly between pancreatic cancer patients and normal healthy subjects, from among the 677 probes shown in FIG. 7 (continuation).

FIG. 8-3 shows 61 probes with expression levels that differed significantly particularly between pancreatic cancer patients and normal healthy subjects, from among the 677 probes shown in FIG. 7 (continuation).

FIG. 8-4 shows 61 probes with expression levels that differed significantly particularly between pancreatic cancer patients and normal healthy subjects, from among the 677 probes shown in FIG. 7 (continuation).

FIG. 9 shows the results of hierarchical clustering using 23352 probes for digestive organ cancer cases and normal healthy subjects.

Figure 10:
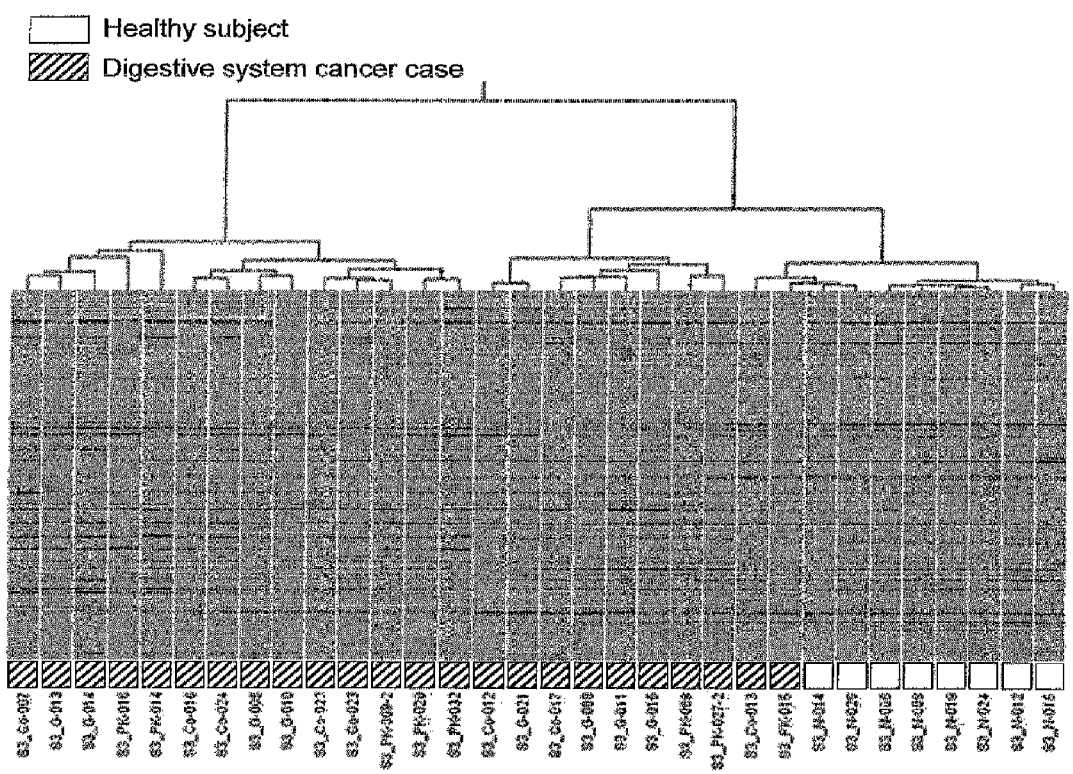

FIG. 10 shows the results of hierarchical clustering using 868 probes corresponding to genes with expression levels that were observed to be attenuated or enhanced in digestive organ cancer cases compared with normal healthy subjects.

Figure 11:
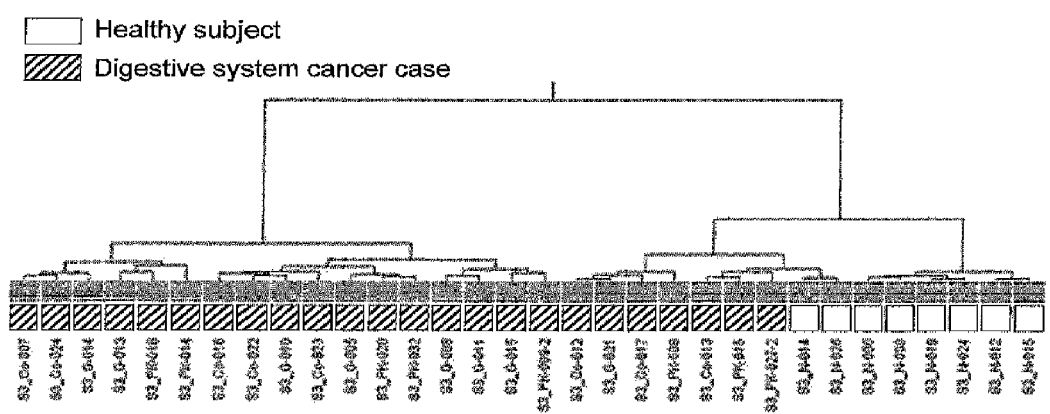

FIG. 11 shows the results of hierarchical clustering using 21 probes corresponding to genes with expression levels that were observed to be attenuated in digestive organ cancer cases at levels 0.4 times or less or enhanced in the same at levels 2.5 times or more than normal healthy subjects.

Figure 12:
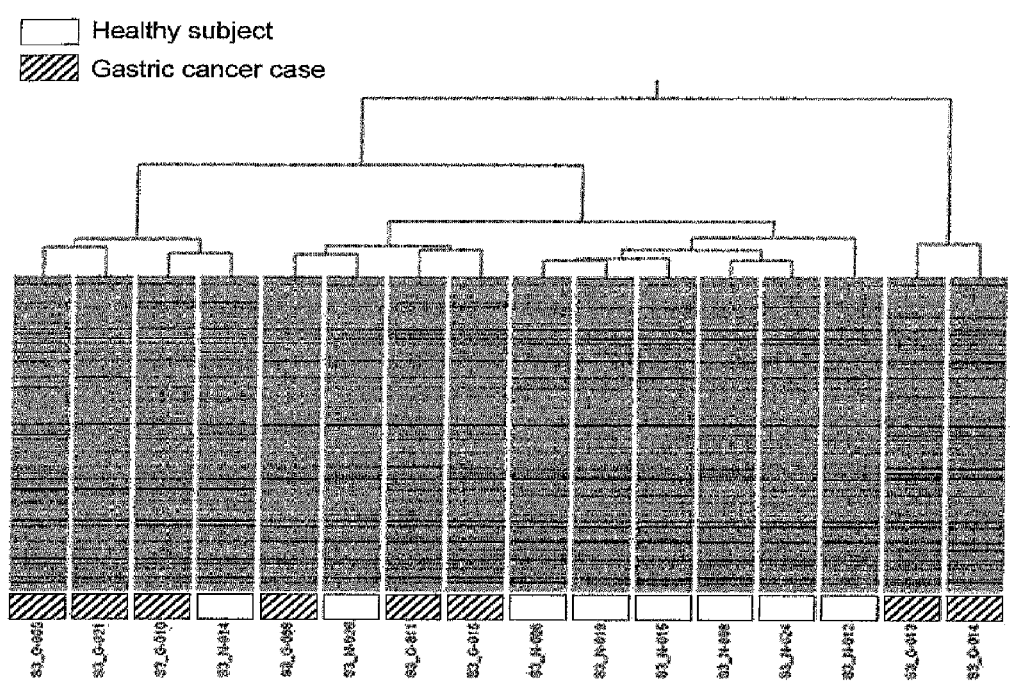

FIG. 12 shows the results of hierarchical clustering using 22155 probes for gastric cancer cases and normal healthy subjects.

Figure 13:
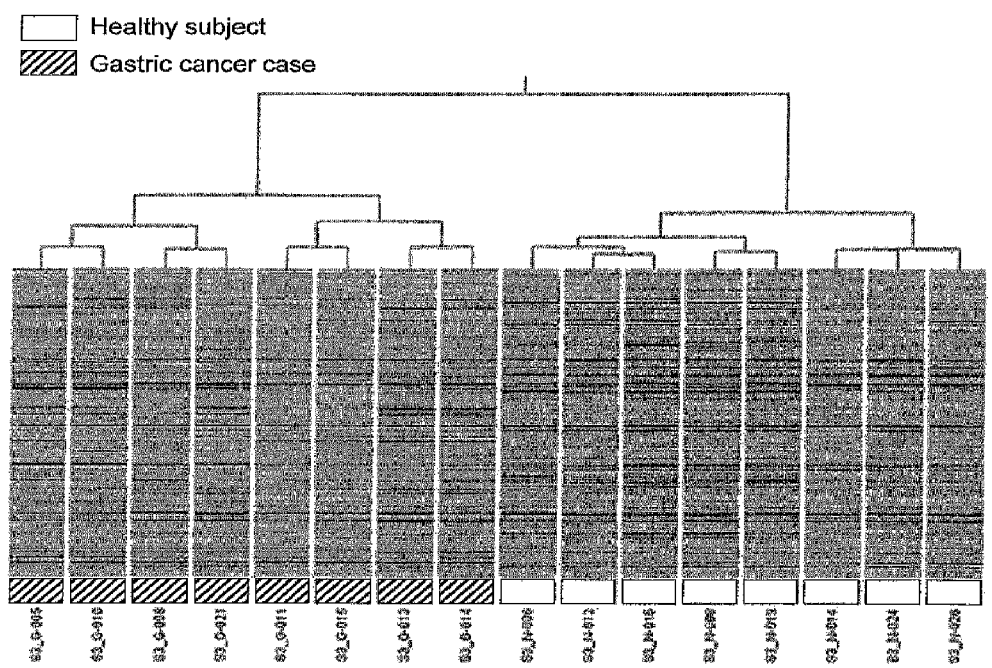

FIG. 13 shows the results of hierarchical clustering using 713 probes corresponding to genes with expression levels that were observed to be attenuated in gastric cancer cases at levels 0.5 times or less or enhanced in the same at levels 2.0 times or more than normal healthy subjects.

Figure 14:
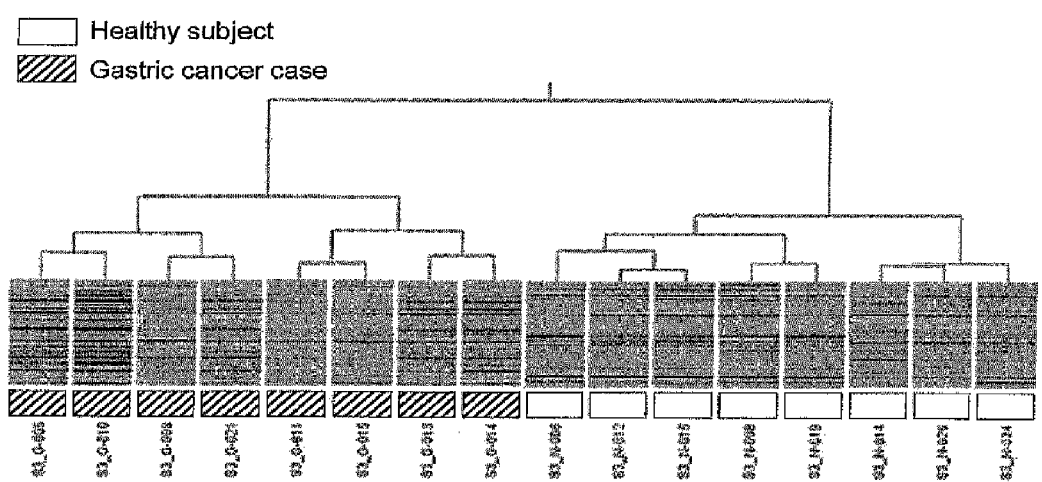

FIG. 14 shows the results of hierarchical clustering using 107 probes corresponding to genes with expression levels that were observed to be attenuated in gastric cancer cases at levels 0.33 times or less or enhanced in the same at levels 3 times or more than normal healthy subjects.

Figure 15:
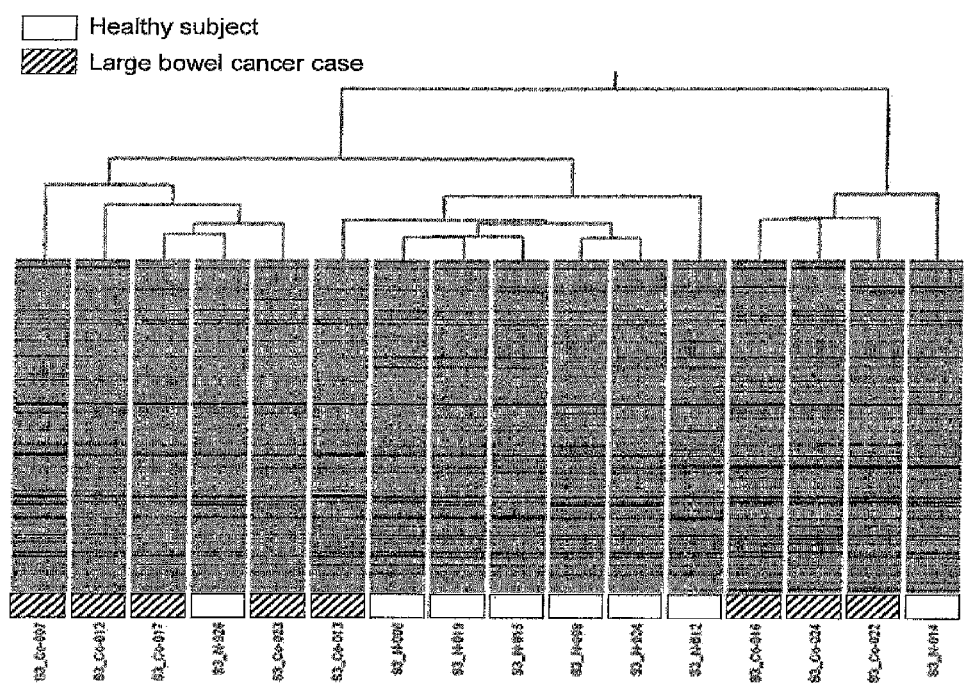

FIG. 15 shows the results of hierarchical clustering using 22181 probes for gastric cancer cases and normal healthy subjects.

Figure 16:
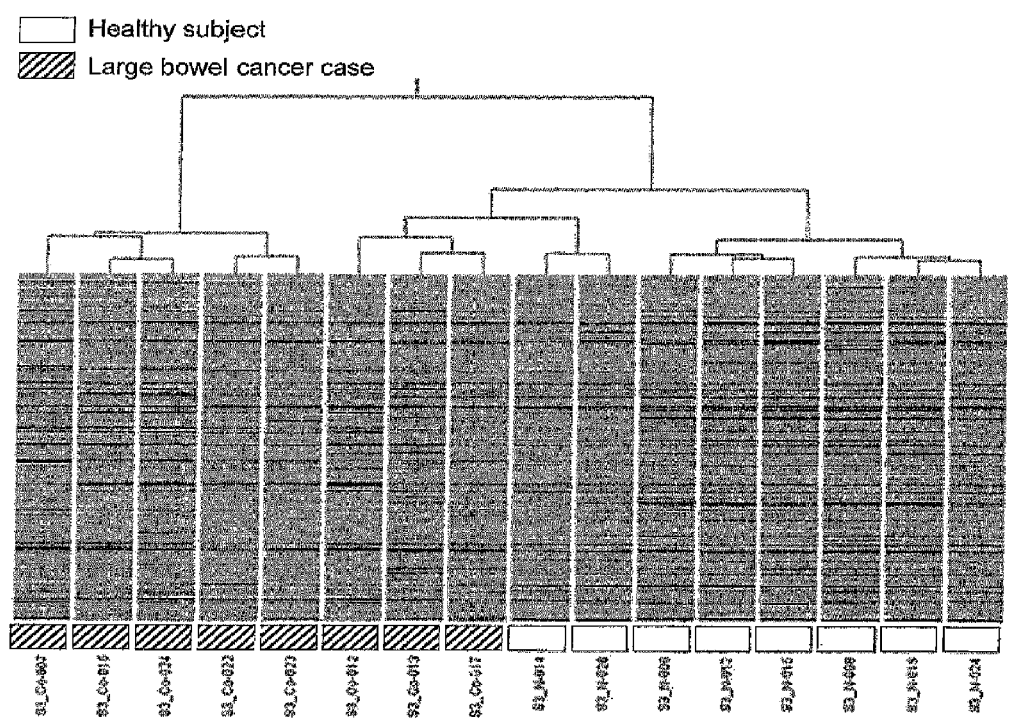

FIG. 16 shows the results of hierarchical clustering using 771 probes corresponding to genes with expression levels that were observed to be attenuated in colorectal cancer cases at levels 0.5 times or less or enhanced in the same at levels 2 times or more than normal healthy subjects.

Figure 17:
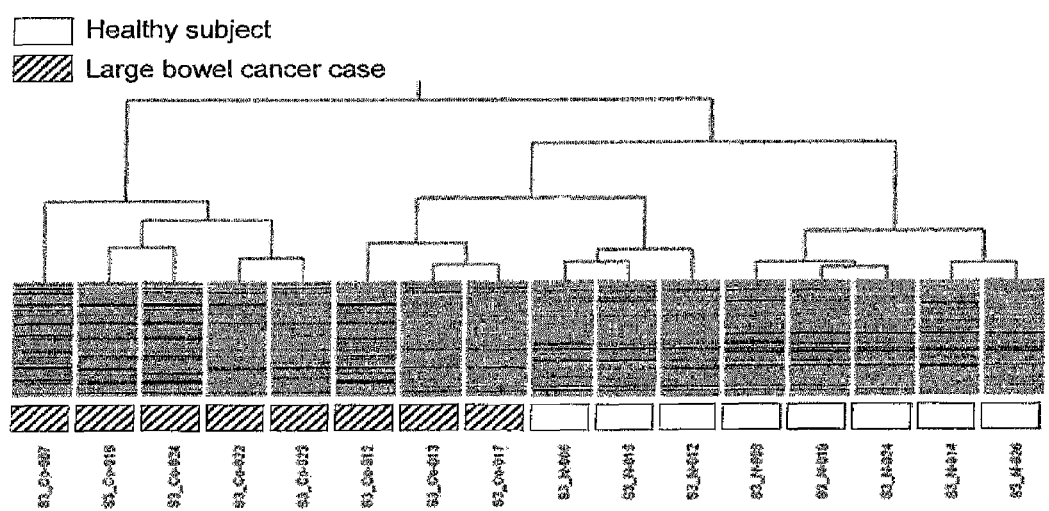

FIG. 17 shows the results of hierarchical clustering using 116 probes corresponding to genes with expression levels that were observed to be attenuated in colorectal cancer cases at levels 0.33 times or less or enhanced in the same at levels 3 times or more than normal healthy subjects.

Figure 18:
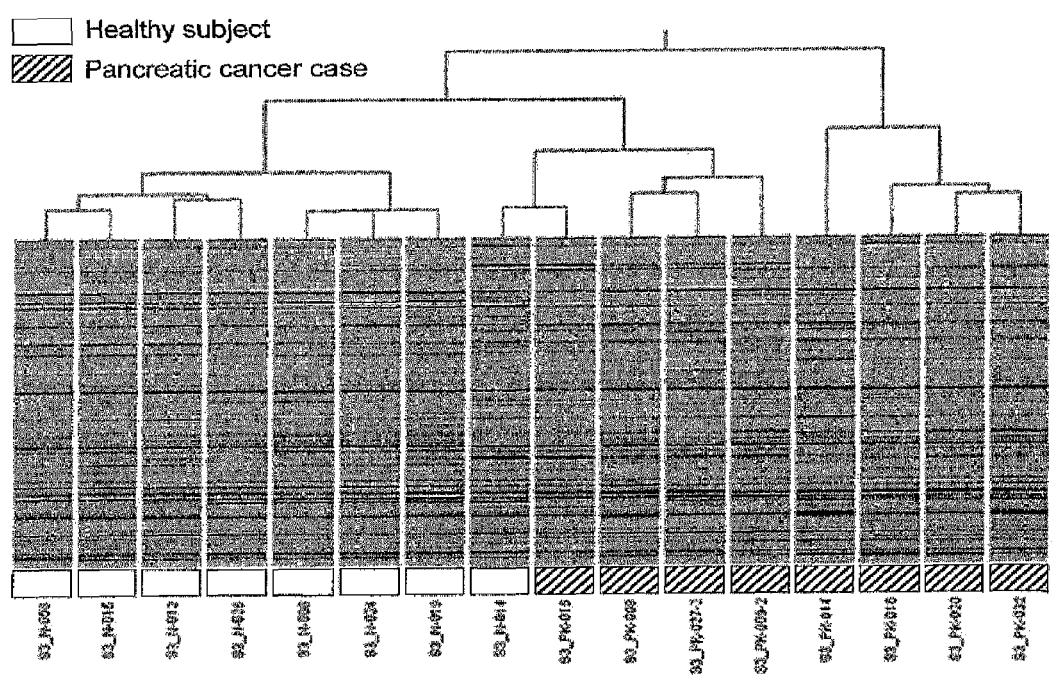

FIG. 18 shows the results of hierarchical clustering using 22149 probes for pancreatic cancer cases and normal healthy subjects.

Figure 19:
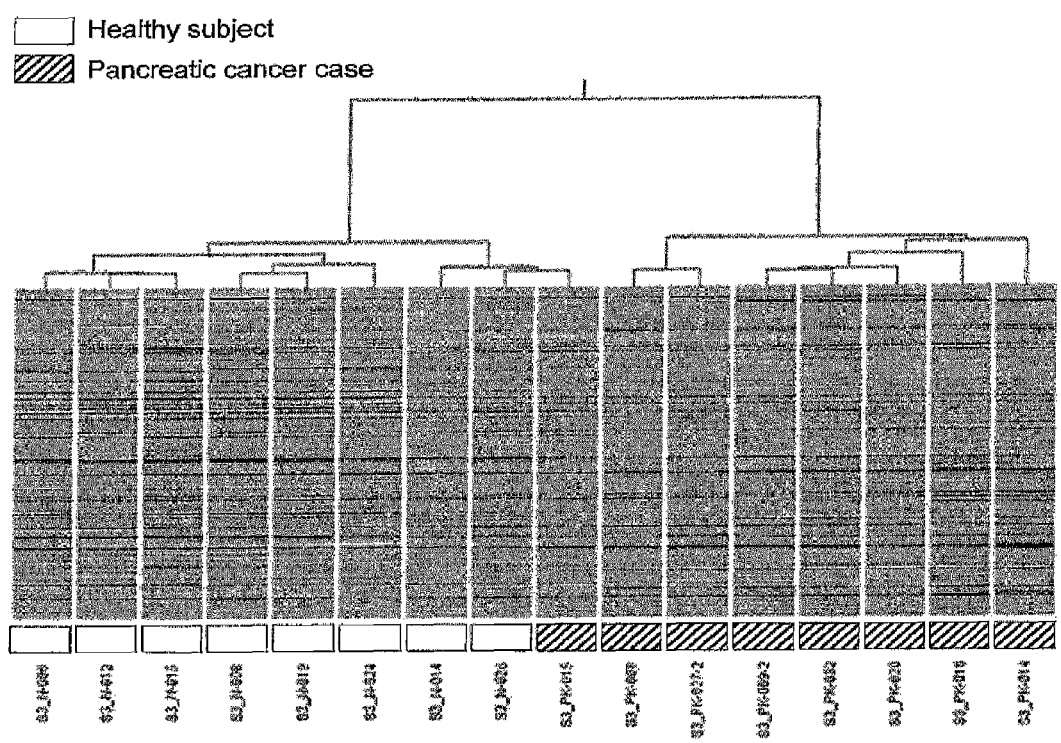

FIG. 19 shows the results of hierarchical clustering using 677 probes corresponding to genes with expression levels that were observed to be attenuated in pancreatic cancer cases at levels 0.5 times or less or enhanced in the same at levels 2 times or more than normal healthy subjects.

Figure 20:
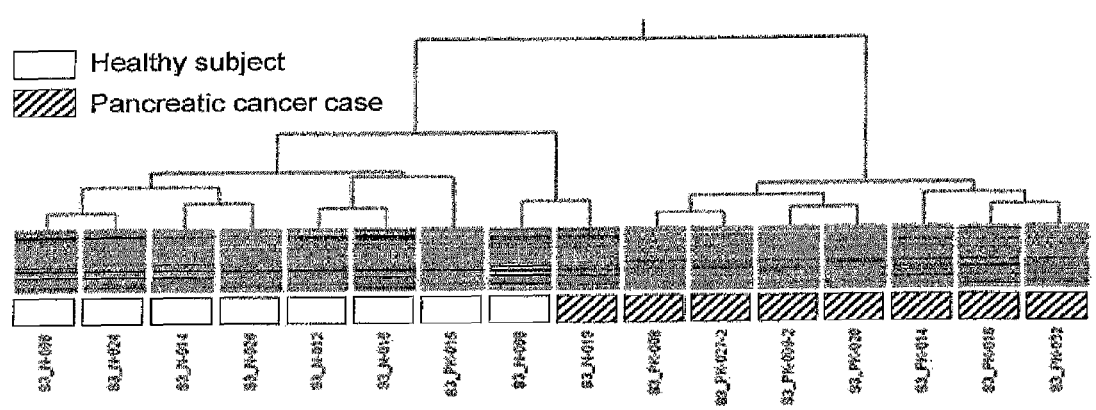

FIG. 20 shows the results of hierarchical clustering using 61 probes corresponding to genes with expression levels that were observed to be attenuated in pancreatic cancer cases at levels 0.33 times or less or enhanced in the same at levels 3 times or more than normal healthy subjects.

FIG. 21-1 shows 25 probes of a 2" probe group that can be used for detection of digestive organ cancer.

FIG. 21-2 shows 25 probes of a 2" probe group that can be used for detection of digestive organ cancer (continuation).

Figure 22:
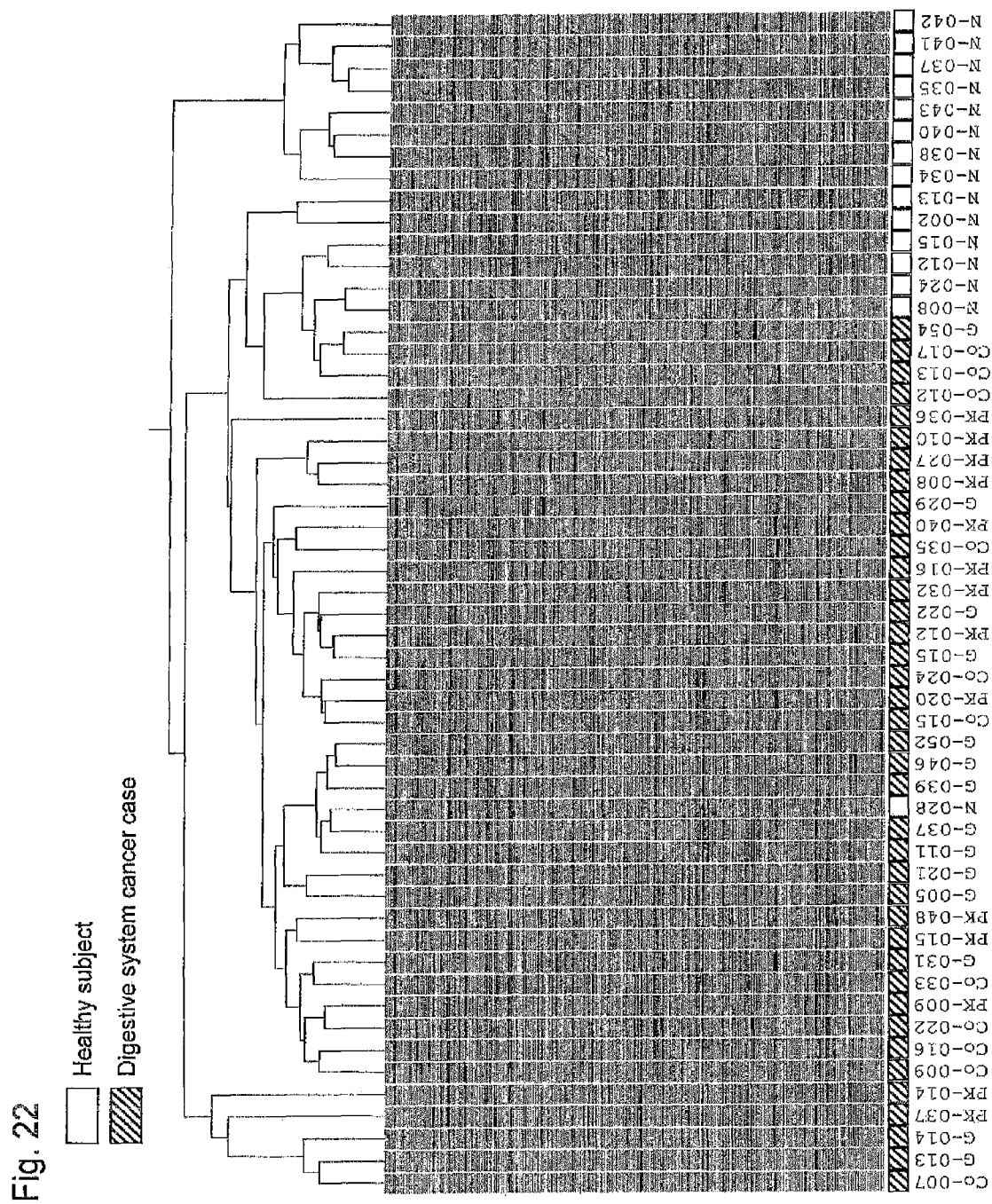

FIG. 22 shows the results of hierarchical clustering using 23278 probes for digestive organ cancer cases and normal healthy subjects.

Figure 23:
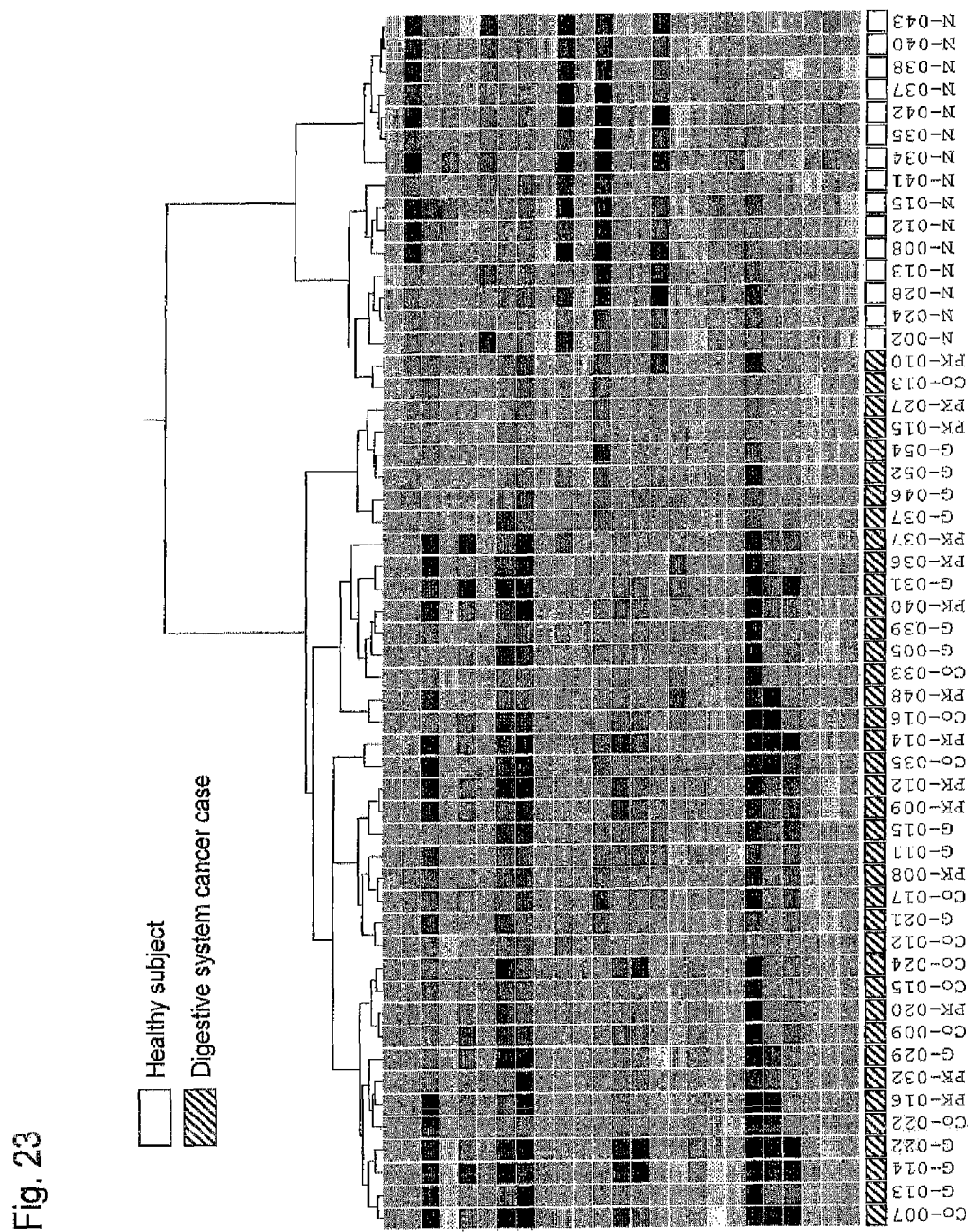

FIG. 23 shows the results of hierarchical clustering using 25 probes corresponding to genes with expression levels that were observed to be attenuated or enhanced in digestive organ cancer cases compared with normal healthy subjects.

FIG. 24-1 shows 363 probes that can be used for detection of biliary tract cancer.

FIG. 24-2 shows 363 probes that can be used for detection of biliary tract cancer (continuation).

FIG. 24-3 shows 363 probes that can be used for detection of biliary tract cancer (continuation).

FIG. 24-4 shows 363 probes that can be used for detection of biliary tract cancer (continuation).

FIG. 24-5 shows 363 probes that can be used for detection of biliary tract cancer (continuation).

FIG. 24-6 shows 363 probes that can be used for detection of biliary tract cancer (continuation).

FIG. 24-7 shows 363 probes that can be used for detection of biliary tract cancer (continuation).

FIG. 24-8 shows 363 probes that can be used for detection of biliary tract cancer (continuation).

FIG. 24-9 shows 363 probes that can be used for detection of biliary tract cancer (continuation).

FIG. 24-10 shows 363 probes that can be used for detection of biliary tract cancer (continuation).

FIG. 24-11 shows 363 probes that can be used for detection of biliary tract cancer (continuation).

FIG. 24-12 shows 363 probes that can be used for detection of biliary tract cancer (continuation).

FIG. 24-13 shows 363 probes that can be used for detection of biliary tract cancer (continuation).

FIG. 24-14 shows 363 probes that can be used for detection of biliary tract cancer (continuation).

FIG. 24-15 shows 363 probes that can be used for detection of biliary tract cancer (continuation).

FIG. 24-16 shows 363 probes that can be used for detection of biliary tract cancer (continuation).

FIG. 24-17 shows 363 probes that can be used for detection of biliary tract cancer (continuation).

FIG. 24-18 shows 363 probes that can be used for detection of biliary tract cancer (continuation).

FIG. 24-19 shows 363 probes that can be used for detection of biliary tract cancer (continuation).

Figure 25:
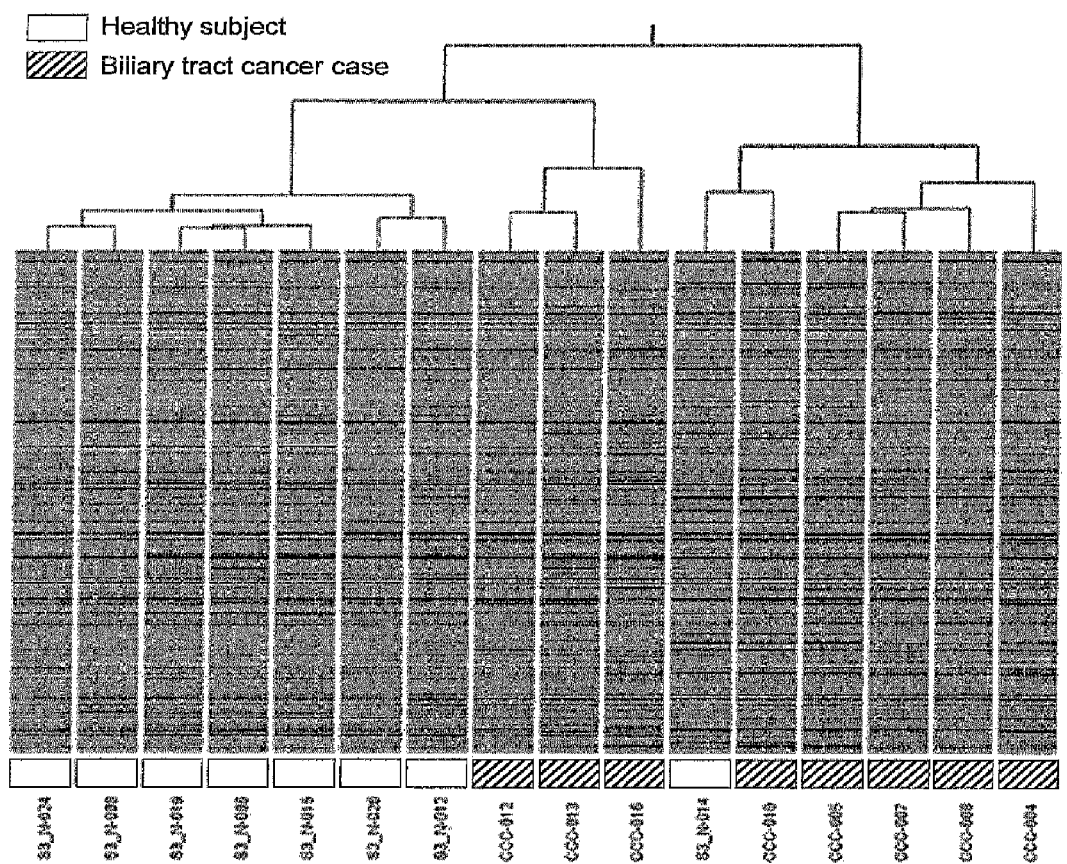

FIG. 25 shows the results of hierarchical clustering using 22066 probes for biliary tract cancer cases and normal healthy subjects.

Figure 26:
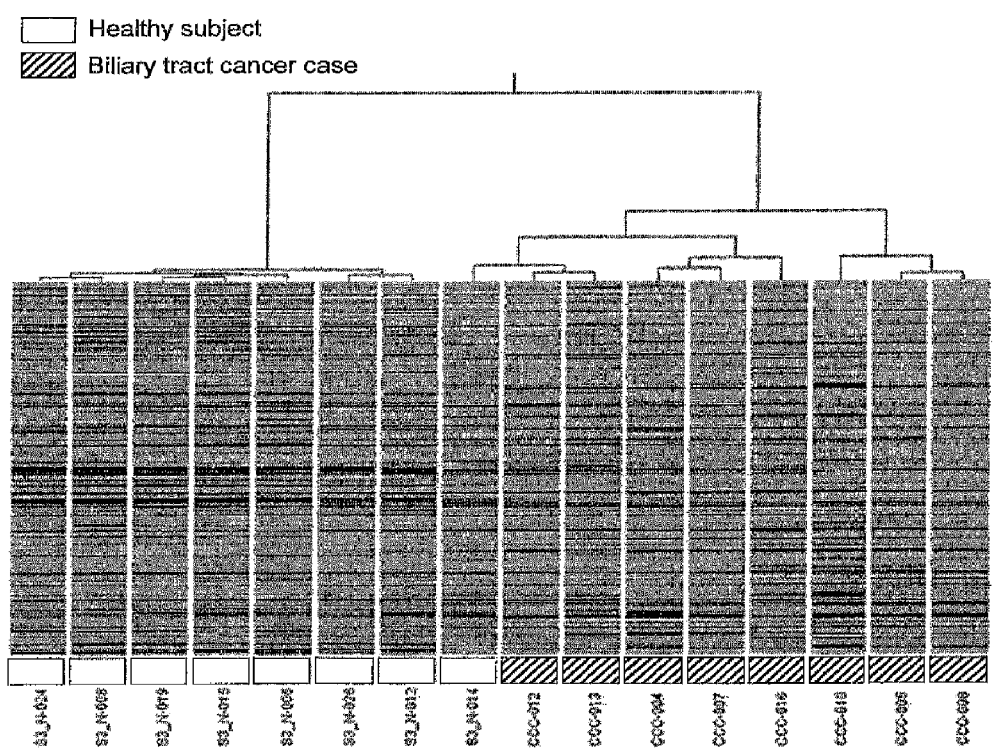

FIG. 26 shows the results of hierarchical clustering using 363 probes corresponding to genes with expression levels that were observed to be attenuated in biliary tract cancer cases at levels 0.33 times or less or enhanced in the same at levels 3 times or more than normal healthy subjects.

BEST MODES FOR CARRYING OUT THE INVENTION

In the present invention, examples of digestive organ cancer include gastric cancer, colorectal cancer, pancreatic cancer, and biliary tract cancer. All of these types of digestive organ cancer can be detected by the method for detecting digestive organ cancer of the present invention. Moreover, gastric cancer, colorectal cancer, pancreatic cancer, or biliary tract cancer can be specifically detected by the method for detecting gastric cancer, colorectal cancer, pancreatic cancer, or biliary tract cancer of the present invention.

The method of the present invention comprises measuring the expression in peripheral blood of:

a gene group with an expression level that varies in digestive organ cancer patients compared with normal healthy subjects;

a gene group with an expression level that varies in gastric cancer patients compared with normal healthy subjects;

a gene group with an expression level that varies in colorectal cancer patients compared with normal healthy subjects;

a gene group with an expression level that varies in pancreatic cancer patients compared with normal healthy subjects; or a gene group with an expression level that varies in biliary tract cancer patients compared with normal healthy subjects, so as to obtain the expression profile of each gene group, and then detecting digestive organ cancer, gastric cancer, colorectal cancer, pancreatic cancer, or biliary tract cancer. Here, examples of such variation in expression include attenuated expression and enhanced expression.

Gene expression in peripheral blood is measured by extracting and isolating mRNA from peripheral blood and then measuring mRNA. mRNA can be extracted and isolated from peripheral blood by a known method. Examples of mRNA that can be extracted and isolated from peripheral blood include mRNAs derived from, in addition to erythrocytes and blood platelets, leukocytes including lymphocytes, monocytes, and granulocytes in peripheral blood, for example.

In the method of the present invention, the expression levels of the above genes are measured.

In the present invention, the term "gene expression level" refers to a gene expression amount, expression intensity, or expression frequency. Such a gene expression level can be generally analyzed based on the production amount of a transcript corresponding to a gene, or the production amount of the translation product therefrom, activity, and the like. Also, the term "expression profiles" refers to information concerning the expression level of each gene. A gene expression level may be expressed with an absolute value or a relative value. In addition, expression profiles may also be referred to as expression patterns.

Expression levels may be measured by measuring gene transcripts (that is, mRNA) or measuring gene translation products (that is, proteins). Preferably, gene expression levels are measured by measuring gene transcripts. An example of a gene transcript is cDNA obtained from mRNA via reverse transcription.

A gene transcript can be measured by measuring the degree of gene expression using nucleotides containing the full-length nucleotide sequences or partial nucleotide sequences of the above genes, or sequences complementary thereto, specifically, nucleotides consisting of the nucleotide sequences consisting of the nucleotide sequences of the genes or partial sequences of the genes, or sequences complementary thereto, as probes or primers. These nucleotides are nucleotides capable of hybridizing to the genes, nucleotides capable of binding to the genes, or nucleotides for detection, which can be used for detection of the genes. The degree of gene expression can be measured by a method using a microarray (microchip), a Northern blot method, or a quantitative PCR method using a gene to be quantitatively determined or a fragment thereof as a target, for example. Examples of a quantitative PCR method include an agarose gel electrophoresis method, a fluorescent probe method, an RT-PCR method, a real-time PCR method, an ATAC-PCR method (Kato, K. et al., Nucl. Acids Res., 25, 4694-4696, 1997), a Taqman PCR method (SYBR (trademark) Green method) (Schmittgen T D, Methods 25, 383-385, 2001), Body Map method (Gene, 174, 151-158 (1996)), a serial analysis of gene expression (SAGE) method (U.S. Pat. Nos. 527,154 and 544,861, EP Publication No. 0761822), and a MAGE method (Micro-analysis of Gene Expression) (JP Patent Publication (Kokai) No. 2000-232888 A). All methods listed herein can be performed by known techniques. The amount of messenger RNA (mRNA) transcribed from the full-length sequence or a partial sequence of the above gene may be measured using these methods. Specifically, the amount of mRNA can be measured using nucleotide probes or primers hybridizing to the mRNA. The base length of a probe or a primer to be used for measurement ranges from 10 bp to 100 bp, preferably ranges from 20 bp to 80 bp, and further preferably ranges from 50 bp to 70 bp.

A DNA microarray (DNA chip) can be prepared by immobilizing nucleotides consisting of the nucleotide sequences of the above genes or partial sequences thereof, or nucleotides containing complementary sequences thereof on an appropriate substrate.

Examples of a substrate for immobilization include glass plates, quartz plates, silicon wafers. Examples of the size of such a substrate include 3.5 mm×5.5 mm, 18 mm×18 mm, and 22 mm×75 mm. The size thereof can be set variously depending on the number of spots for probes or the size of the spots on a substrate. Polynucleotides or fragments thereof can be immobilized by the following methods. Polynucleotides or fragments thereof can be electrostatically bound to a solid-phase support surface-treated with a polycation such as polylysine, polyethylene imine, or polyalkylamine with the use of the electric charge of nucleotides. Alternatively, nucleotides, into which a functional group such as an amino group, an aldehyde group, an SH group, or biotin has been introduced, are covalently bound to the surface of a solid phase to which a functional group such as an amino group, an aldehyde group, or an epoxy group has been introduced. Immobilization may be performed using an array system. A DNA microarray is prepared by immobilizing at least one of genes corresponding to the above 868 probes or a fragment thereof to a substrate, the DNA microarray is brought into contact with subject-derived mRNA or cDNA labeled with a fluorescent substance for hybridization, and then fluorescence intensity on the DNA microarray is measured, so that the type and the amount of the mRNA can be determined. As a result, a gene(s) with expression levels that vary in a subject, can be detected, so that the gene expression profile can be obtained. A fluorescent substance for labeling subject-derived mRNA is not limited and any commercially available fluorescent substance can be used. For example, Cy3 and Cy5 may be used. mRNA can be labeled by a known method.

In the present invention, the term "probe" refers to the sequence of a nucleotide arranged on a DNA microarray. One nucleotide sequence is designated for one probe ID No. There is a single gene that corresponds to a plurality of probes comprising different nucleotide sequences. The expression "a probe(s) corresponding) to a gene(s)" means that the sequence of the probe is complementary to a partial nucleotide sequence of the gene or a sequence complementary thereto, so that the gene can hybridize to the probe. The nucleotide sequence of a gene corresponding to a probe contains the nucleotide sequence of the probe or a nucleotide sequence complementary thereto as a partial sequence.

Examples of nucleotides to be used as probes or primers in the present invention include nucleotides containing the sequences of the above genes, nucleotides consisting of the sequences of fragments thereof, and nucleotides consisting of sequences complementary to these sequences. Further examples of nucleotides to be used in the present invention include nucleotides hybridizing under stringent conditions to nucleotides having the above nucleotide sequences and nucleotides consisting of the sequences of the fragments thereof. Specific examples of such a nucleotide include a nucleotide and the like containing the nucleotide sequence having the degree of homology with the above nucleotide sequences, about 80% or more, preferably about 90% or more, and more preferably about 95% or more on an overall average. Hybridization can be performed according to a method known in the art or a method according thereto, such as the methods described in Current Protocols in Molecular Biology (Current protocols in molecular biology (edited by Frederick M. Ausubel et al., 1987)). Also, when a commercially available library is used, hybridization can be performed according to the methods described in the attached instructions. Here, the term "stringent conditions" refers to conditions of about "1×SSC, 0.1% SDS, 37° C.," more stringent conditions refer to conditions of about "0.5×SSC, 0.1% SDS, and 42° C.," and even more stringent conditions refer to conditions of about "0.2×SSC, 0.1% SDS, 65° C." As such, higher stringency of hybridization conditions enables isolation of a nucleotide having high homology with the probe sequence. Here, the above combinations of SSC, SDS, and temperature are merely examples. Persons skilled in the art can realize stringency similar to the above by appropriately combining the above or other factors (e.g., probe concentration, probe length, and reaction time for hybridization) for determination of stringency for hybridization. Moreover, these genes may have variants. Hence, examples of genes to be used in the present invention include variants of the above genes. The nucleotide sequences of variants can be obtained by accessing a gene database. Examples of the nucleotides of the present invention include nucleotides containing the nucleotide sequences of the variants or nucleotides consisting of the sequences of the fragments thereof.

Also, as a nucleotide to be used in the present invention, either a nucleotide consisting of a sense strand of the above gene or a nucleotide consisting of the antisense strand of the same can be used.

FIG. 1 (FIG. 1-1 to FIG. 1-48) shows 868 probes of the 1$^{st}$ probe group that can be used for detection of digestive organ cancer. FIG. 1 shows probe ID numbers, symbols of genes corresponding to the probes, the nucleotide sequences (SEQ ID NOs: 1-868) of the probes, and descriptions of genes corresponding to the probes (gene names and GenBank accession numbers). The full-length sequences of these genes are known. Arbitrary partial sequences can be used as nucleotides for detection of the genes. FIG. 2 shows the nucleotide sequences (SEQ ID NOs: 220, 506, 508, 523, 538, 554, 570, 589, 597, 602, 618, 654, 689, 701, 726, 744, 762, 763, 781, 795, and 849) of 21 probes with expression levels that differ significantly particularly between digestive organ cancer patients and normal healthy subjects, from among the 868 probes shown in FIG. 1. In FIG. 1, genes corresponding to 555 probes (No. 1 to No. 555) (SEQ ID NOs: 1-555) exhibit attenuated expression in digestive organ cancer patients compared with normal healthy subjects. Genes corresponding to 313 probes (No. 556 to No. 868) (SEQ ID NOs: 556-868) exhibit enhanced expression in digestive organ cancer patients compared with normal healthy subjects. Also, in FIG. 2, genes corresponding to probes No. 1 to No. 6 (SEQ ID NOs: 220, 506, 508, 523, 538, and 554) exhibit attenuated expression in digestive organ cancer patients compared with normal healthy subjects. Genes corresponding to probes No. 7 to No. 21 (SEQ ID NOs: 570, 589, 597, 602, 618, 654, 689, 701, 726, 744, 762, 763, 781, 795, and 849) exhibit enhanced expression in digestive organ cancer patients compared with normal healthy subjects.

Furthermore, FIG. 21 (FIG. 21-1 and FIG. 21-2) shows 25 probes of the 2$_{nd}$ probe group that can be used for detection of digestive organ cancer. FIG. 21 shows probe ID numbers, symbols of genes corresponding to the probes, the nucleotide sequences (SEQ ID NOs: 3030-3054) of the probes, and descriptions of genes corresponding to the probes (gene names and GenBank accession numbers). The full-length sequences of these genes are known. Arbitrary partial sequences can be used as nucleotides for detection of the genes.

FIG. 3 (FIG. 3-1 to FIG. 3-39) shows 713 probes that can be used for detection of gastric cancer. FIG. 3 shows probe ID numbers, symbols of genes corresponding to the probes, the nucleotide sequences (SEQ ID NOs: 869-1581) of the probes, and descriptions of genes corresponding to the probes (gene names and GenBank accession numbers). The full-length sequences of these genes are known. Arbitrary partial sequences can be used as nucleotides for detection of the genes. FIG. 4 (FIG. 4-1 to FIG. 4-6) shows the nucleotide sequences (SEQ ID NO: 923, 927, 929, 932, 946, 952, 986, 998, 1000, 1006, 1007, 1013, 1019, 1020, 1022, 1027, 1039, 1046, 1073, 1090, 1107, 1108, 1117, 1121, 1132, 1134, 1154, 1162, 1179, 1183, 1191, 1205, 1207, 1211, 1216, 1217, 1224, 1239, 1244, 1251, 1254, 1255, 1283, 1285, 1301, 1304, 1316, 1317, 1327, 1328, 1331, 1332, 1345, 1359, 1365, 1366, 1372, 1373, 1375, 1379, 1380, 1382, 1383, 1393, 1394, 1396, 1397, 1404, 1405, 1406, 1407, 1421, 1423, 1426, 1430, 1440, 1441, 1442, 1448, 1450, 1454, 1455, 1456, 1459, 1466, 1467, 1491, 1497, 1500, 1502, 1504, 1508, 1513, 1514, 1519, 1531, 1534, 1544, 1546, 1549, 1551, 1560, 1563, 1566, 1570, 1571, and 1578) of 107 probes with expression levels that differ significantly particularly between gastric cancer patients and normal healthy subjects, from among the 713 probes shown in FIG. 3. In FIG. 3, genes corresponding to 84 probes (No. 1 to No. 84) (SEQ ID NOs: 869-952) exhibit attenuated expression in gastric cancer patients compared with normal healthy subjects. Genes corresponding to 629 probes (No. 85 to No. 713) (SEQ ID NOs: 953-1581) exhibit enhanced expression in gastric cancer patients compared with normal healthy subjects. Also, in FIG. 4, genes corresponding to probes No. 1 to No. 6 (SEQ ID NOs: 923, 927, 929, 932, 946, and 952) exhibit attenuated expression in gastric cancer patients compared with normal healthy subjects. Genes corresponding to probes No. 7 to No. 107 (SEQ ID NOs: 986, 998, 1000, 1006, 1007, 1013, 1019, 1020, 1022, 1027, 1039, 1046, 1073, 1090, 1107, 1108, 1117, 1121, 1132, 1134, 1154, 1162, 1179, 1183, 1191, 1205, 1207, 1211, 1216, 1217, 1224, 1239, 1244, 1251, 1254, 1255, 1283, 1285, 1301, 1304, 1316, 1317, 1327, 1328, 1331, 1332, 1345, 1359, 1365, 1366, 1372, 1373, 1375, 1379, 1380, 1382, 1383, 1393, 1394, 1396, 1397, 1404, 1405, 1406, 1407, 1421, 1423, 1426, 1430, 1440, 1441, 1442, 1448, 1450, 1454, 1455, 1456, 1459, 1466, 1467, 1491, 1497, 1500, 1502, 1504, 1508, 1513, 1514, 1519, 1531, 1534, 1544, 1546, 1549, 1551, 1560, 1563, 1566, 1570, 1571, and 1578) exhibit enhanced expression in gastric cancer patients compared with normal healthy subjects.

FIG. 5 (FIG. 5-1 to FIG. 5-41) shows 771 probes that can be used for detection of colorectal cancer. FIG. 5 shows probe ID numbers, symbols of genes corresponding to the probes, the nucleotide sequences (SEQ ID NOs: 1582-2352) of the probes, and descriptions of genes corresponding to the probes (gene names and GenBank accession numbers). The full-length sequences of these genes are known. Arbitrary partial sequences can be used as nucleotides for detection of the genes. FIG. 6 (FIG. 6-1 to FIG. 6-6) shows 116 probes (SEQ ID NO: 1583, 1601, 1611, 1614, 1644, 1651, 1678, 1680, 1684, 1737, 1746, 1750, 1751, 1757, 1760, 1765, 1766, 1773, 1778, 1779, 1780, 1782, 1787, 1794, 1795, 1798, 1802, 1831, 1836, 1837, 1853, 1854, 1869, 1871, 1873, 1876, 1880, 1890, 1892, 1896, 1925, 1942, 1950, 1953, 1962, 1970, 1977, 1978, 1985, 1990, 1991, 2000, 2004, 2007, 2011, 2018, 2019, 2023, 2032, 2046, 2050, 2054, 2077, 2085, 2088, 2095, 2105, 2126, 2128, 2132, 2138, 2140, 2143, 2144, 2145, 2147, 2158, 2160, 2161, 2173, 2175, 2176, 2180, 2191, 2193, 2198, 2207, 2209, 2213, 2217, 2218, 2223, 2227, 2233, 2247, 2255, 2257, 2258, 2261, 2266, 2268, 2269, 2273, 2280, 2286, 2296, 2306, 2317, 2320, 2322, 2325, 2332, 2334, 2336, 2339, and 2340) with expression levels that differ significantly particularly between colorectal cancer patients and normal healthy subjects, from among 771 probes shown in FIG. 5. In FIG. 5, genes corresponding to 125 probes (No. 1 to No. 125) (SEQ ID NOs: 1582-1706) exhibit attenuated expression in colorectal cancer patients compared with normal healthy subjects. Genes corresponding to 646 probes (No. 126 to No. 771) (SEQ ID NOs: 1707-2352) exhibit enhanced expression in colorectal cancer patients compared with normal healthy subjects. Also, in FIG. 6, genes corresponding to probes No. 1 to No. 9 (SEQ ID NOs: 1583, 1601, 1611, 1614, 1644, 1651, 1678, 1680, and 1684) exhibit attenuated expression in colorectal cancer patients compared with normal healthy subjects. Genes corresponding to probes No. 10 to No. 116 (SEQ ID NOs: 1737, 1746, 1750, 1751, 1757, 1760, 1765, 1766, 1773, 1778, 1779, 1780, 1782, 1787, 1794, 1795, 1798, 1802, 1831, 1836, 1837, 1853, 1854, 1869, 1871, 1873, 1876, 1880, 1890, 1892, 1896, 1925, 1942, 1950, 1953, 1962, 1970, 1977, 1978, 1985, 1990, 1991, 2000, 2004, 2007, 2011, 2018, 2019, 2023, 2032, 2046, 2050, 2054, 2077, 2085, 2088, 2095, 2105, 2126, 2128, 2132, 2138, 2140, 2143, 2144, 2145, 2147, 2158, 2160, 2161, 2173, 2175, 2176, 2180, 2191, 2193, 2198, 2207, 2209, 2213, 2217, 2218, 2223, 2227, 2233, 2247, 2255, 2257, 2258, 2261, 2266, 2268, 2269, 2273, 2280, 2286, 2296, 2306, 2317, 2320, 2322, 2325, 2332, 2334, 2336, 2339, and 2340) exhibit enhanced expression in colorectal cancer patients compared with normal healthy subjects.

FIG. 7 (FIG. 7-1 to FIG. 7-37) shows 677 probes that can be used for detection of pancreatic cancer. FIG. 7 shows probe ID numbers, symbols of genes corresponding to the probes, the nucleotide sequences (SEQ ID NOs: 2353-3029) of the probes, and descriptions of genes corresponding to the probes (gene names and GenBank accession numbers). The full-length sequences of these genes are known. Arbitrary partial sequences can be used as nucleotides for detection of the genes. FIG. 8 (FIG. 8-1 to FIG. 8-3) shows 61 probes (SEQ ID NOs: 2373, 2404, 2418, 2419, 2426, 2430, 2459, 2461, 2469, 2475, 2507, 2514, 2515, 2525, 2543, 2600, 2602, 2621, 2628, 2634, 2640, 2651, 2652, 2674, 2677, 2680, 2681, 2691, 2692, 2700, 2714, 2715, 2719, 2723, 2724, 2738, 2740, 2746, 2748, 2763, 2778, 2781, 2815, 2818, 2823, 2842, 2857, 2861, 2885, 2898, 2902, 2903, 2932, 2934, 2972, 2975, 2982, 2985, 2999, 3001, and 3003) with expression levels that differ significantly particularly between pancreatic cancer patients and normal healthy subjects, from among 677 probes. In FIG. 7, genes corresponding to 96 probes (No. 1 to No. 96) (SEQ ID NOs: 2353-2448) exhibit attenuated expression in pancreatic cancer patients compared with normal healthy subjects. Genes corresponding to 581 probes (No. 97 to No. 677) (SEQ ID NO: 2449 to 3029) exhibit enhanced expression in pancreatic cancer patients compared with normal healthy subjects. Also, in FIG. 8, genes corresponding to probes No. 1 to No. 6 (SEQ ID NOs: 2373, 2404, 2418, 2419, 2426, and 2430) exhibit attenuated expression in pancreatic cancer patients compared with normal healthy subjects. Genes corresponding to probes No. 7 to No. 61 (SEQ ID NOs: 2459, 2461, 2469, 2475, 2507, 2514, 2515, 2525, 2543, 2600, 2602, 2621, 2628, 2634, 2640, 2651, 2652, 2674, 2677, 2680, 2681, 2691, 2692, 2700, 2714, 2715, 2719, 2723, 2724, 2738, 2740, 2746, 2748, 2763, 2778, 2781, 2815, 2818, 2823, 2842, 2857, 2861, 2885, 2898, 2902, 2903, 2932, 2934, 2972, 2975, 2982, 2985, 2999, 3001, and 3003) exhibit enhanced expression in pancreatic cancer patients compared with normal healthy subjects.

FIG. 24 (FIG. 24-1 to FIG. 24-19) shows 363 probes that can be used for detection of biliary tract cancer. FIG. 24 shows probe ID numbers, symbols of genes corresponding to the probes, the nucleotide sequences (SEQ ID NOs: 3055-3417) of the probes, and descriptions of genes corresponding to the probes (gene names and GenBank accession numbers). The full-length sequences of these genes are known. Arbitrary partial sequences can be used as nucleotides for detection of the genes. In FIG. 24, genes corresponding to 98 probes (No. 1 to No. 98) (SEQ ID NOs: 3055-3152) exhibit attenuated expression in biliary tract cancer patients compared with normal healthy subjects. Genes corresponding to 265 probes (No. 99 to No. 363) (SEQ ID NOs: 3153-3417) exhibit enhanced expression in biliary tract cancer patients compared with normal healthy subjects.

The method for detecting digestive organ cancer of the present invention comprises measuring the expression levels of genes (described in the rightmost column in FIG. 1) in peripheral blood of a subject using at least one of 868 probes shown in FIG. 1, wherein the genes correspond to the 868 probes. At this time, with the use of at least 1 to 867 probes from among the 868 probes shown in FIG. 1, specifically at least 1, 2, 3, 4, 5, 6, 7, 8, 9, 10, 50, 100, 150, 200, 250, 300, 350, 400, 450, 500, 550, 600, 650, 700, 750, 800, 850, 867, or 868 probes, the expression levels of the genes corresponding thereto are measured. Also, with the use of at least one of probes corresponding to genes that exhibit attenuated expression in a group of digestive organ cancer patients, the expression level of the gene corresponding thereto may be measured. Also, with the use of at least one of probes corresponding to genes that exhibit enhanced expression in a group of digestive organ cancer patients, the expression level of the gene corresponding to the probe may be measured. Furthermore, with the use of a combination of at least one of probes corresponding to genes that exhibit attenuated expression in a group of digestive organ cancer patients and at least one of probes corresponding to genes that exhibit enhanced expression in the group of digestive organ cancer patients, the expression levels of the genes corresponding to the probes may be measured. Specifically, with the use of at least one of 555 probes (No. 1 to No. 555) (SEQ ID NOs: 1-555) shown in FIG. 1, the expression level of at least one of the genes corresponding to the probes may be measured. At this time, with the use of at least 1 to 554 probes from among the 555 probes, specifically at least 1, 2, 3, 4, 5, 6, 7, 8, 9, 10, 50, 100, 150, 200, 250, 300, 350, 400, 450, 500, 550, 554, or 555 probes, the expression levels of the genes corresponding thereto may be measured. Also, with the use of at least one of 313 probes (No. 556 to No. 868) (SEQ ID NOs: 556-868) shown in FIG. 1, the expression level of the gene corresponding thereto may be measured. At this time, with the use of at least 1 to 312 probes from among the 313 probes, specifically at least 1, 2, 3, 4, 5, 6, 7, 8, 9, 10, 50, 100, 150, 200, 250, 300, 312, or 313 probes, the expression levels of the genes corresponding thereto may be measured. Furthermore, with the use of a combination of at least one of the 555 probes (No. 1 to No. 555) (SEQ ID NOs: 1-555) shown in FIG. 1 and at least one of the 313 probes (No. 556 to No. 868) (SEQ ID NOs: 556-868) shown in FIG. 1, the expression levels of the genes corresponding thereto may be measured.

Furthermore, with the use of at least one of 21 probes shown in FIG. 2 corresponding particularly to genes with expression levels that vary significantly from among genes corresponding to the above 868 probes, the expression levels of the genes (described in the rightmost column in FIG. 2) corresponding to the probes may be measured. At this time, with the use of the 21 probes, specifically 1, 2, 3, 4, 5, 6, 7, 8, 9, 10, 11, 12, 13, 14, 15, 16, 17, 18, 19, 20, or 21 probes, the expression levels of the genes corresponding to the probes may be measured. Also, with the use of at least one of probes No. 1 to No. 6 (from among the 21 probes shown in FIG. 2) corresponding to genes that exhibit attenuated expression in digestive organ cancer patients compared with normal healthy subjects, the expression levels of the genes may be measured. With the use of, from among the 21 probes shown in FIG. 2, at least one of probes No. 7 to No. 21 corresponding to genes that exhibit enhanced expression in digestive organ cancer patients compared with normal healthy subjects, the expression levels of the genes may be measured. Furthermore, with the use of a combination of at least one of the probes No. 1 to No. 6 and at least one of the probes No. 7 to No. 21, the expression levels of the genes may be measured. At this time, 1, 2, 3, 4, 5, or 6 probes of the probes No. 1 to No. 6 may be used and 1, 2, 3, 4, 5, 6, 7, 8, 9, 10, 11, 12, 13, 14, or 15 probes of the probes No. 7 to No. 21 may be used.

The method for detecting digestive organ cancer of the present invention comprises measuring the expression levels of genes (described in the rightmost column in FIG. 1A) in peripheral blood of a subject using at least one of 25 probes shown in FIG. 21, wherein the genes correspond to the 25 probes. At this time, with the use 1, 2, 3, 4, 5, 6, 7, 8, 9, 10, 11, 12, 13, 14, 15, 16, 17, 18, 19, 20, 21, 22, 23, 24, or 25 probes shown in FIG. 1A, the expression levels of the genes corresponding thereto may be measured. Also, with the use of at least one of probes corresponding to genes that exhibit attenuated expression in a group of digestive organ cancer patients, the expression level of the gene corresponding thereto may be measured. Also, with the use of at least one of probes corresponding to genes that exhibit enhanced expression in a group of digestive organ cancer patients, the expression level of the gene corresponding thereto may be measured. Furthermore, with the use of a combination of at least one of probes corresponding to genes that exhibit attenuated expression in a group of digestive organ cancer patients and at least one of probes corresponding to genes that exhibit enhanced expression in the group of digestive organ cancer patients, the expression levels of the genes corresponding to the probes may be measured. Specifically, with the use of at least one of 14 probes (No. 1 to No. 14) (SEQ ID NOs: 3030-3043) shown in FIG. 21, the expression level of at least one of the genes corresponding to the probes may be measured. At this time, with the use of 14 probes, specifically, 1, 2, 3, 4, 5, 6, 7, 8, 9, 10, 11, 12, 13, or 14 probes, the expression levels of the genes corresponding thereto may be measured. Also, with the use of at least one of 11 probes (No. 15 to No. 25) (SEQ ID NOs: 3044-3054) shown in FIG. 21, the expression level of the gene corresponding to the probe may be measured. At this time, with the use of 11 probes, specifically, 1, 2, 3, 4, 5, 6, 7, 8, 9, 10, or 11 probes, the expression levels of the genes corresponding thereto may be measured. Furthermore, with the use of a combination of at least one of 14 probes (No. 1 to No. 14) (SEQ ID NOs: 3030-3043) shown in FIG. 21 and at least one of 11 probes (No. 15 to No. 25) (SEQ ID NOs: 3044-3054) shown in FIG. 21, the expression levels of the genes corresponding thereto may be measured.

The method for detecting gastric cancer of the present invention comprises measuring the expression levels of genes in peripheral blood of a subject (described in the rightmost column in FIG. 3) using at least one of 713 probes shown in FIG. 3, wherein the genes correspond to the 713 probes. At this time, with the use of at least 1 to 712 probes from among the 713 probes shown in FIG. 3, specifically at least 1, 2, 3, 4, 5, 6, 7, 8, 9, 10, 50, 100, 150, 200, 250, 300, 350, 400, 450, 500, 550, 600, 650, 700, 712, or 713 probes, the expression levels of the genes corresponding thereto may be measured. Also, with the use of at least one of probes corresponding to genes that exhibit attenuated expression in a group of gastric cancer patients, the expression level of the gene corresponding thereto may be measured. Also, with the use of at least one of probes corresponding to genes that exhibit enhanced expression in a group of gastric cancer patients, the expression level of the gene corresponding to the probe may be measured. Furthermore, with the use of a combination of at least one of probes corresponding to genes that exhibit attenuated expression in a group of gastric cancer patients and at least one of probes corresponding to genes that exhibit enhanced expression in the group of gastric cancer patients, the expression levels of the genes corresponding to the probes may be measured. Specifically, with the use of at least one of 84 probes (No. 1 to No. 84) (SEQ ID NOs: 869-952) shown in FIG. 1, the expression level of at least one of the genes corresponding to the probes may be measured. At this time, with the use of at least 1 to 83 probes from among the 84 probes, specifically at least 1, 2, 3, 4, 5, 6, 7, 8, 9, 10, 20, 30, 40, 50, 60, 70, 80, 83, or 84 probes, the expression levels of the genes corresponding thereto may be measured. Also, with the use of at least one of 629 probes (No. 85 to No. 713) (SEQ ID NOs: 953-1581) shown in FIG. 3, the expression levels of the genes corresponding to the probes may be measured. At this time, with the use of at least 1 to 628 probes from among the 629 probes, specifically at least 1, 2, 3, 4, 5, 6, 7, 8, 9, 10, 50, 100, 150, 200, 250, 300, 350, 400, 450, 500, 550, 600, 628, or 629 probes, the expression levels of the genes corresponding thereto may be measured. Furthermore, with the use of a combination of at least one of the 84 probes (No. 1 to No. 84) (SEQ ID NOs: 869-952) shown in FIG. 3 and at least one of the 629 probes (No. 85 to No. 713) (SEQ ID NOs: 953-1581) shown in FIG. 3, the expression levels of the genes corresponding to the probes may be measured.

Furthermore, with the use of at least one of 107 probes shown in FIG. 4 corresponding particularly to genes with expression levels that vary significantly from among the genes corresponding to the above 713 probes, the expression levels of the genes (described in the rightmost column in FIG. 4) corresponding to the probes may be measured. At this time, with the use of the 107 probes, specifically at least 1, 2, 3, 4, 5, 6, 7, 8, 9, 10, 20, 30, 40, 50, 60, 70, 80, 90, 100, 106, or 107 probes, the expression levels of the genes corresponding to the probes may be measured. Also, with the use of at least one of probes No. 1 to No. 6 (from among the 107 probes shown in FIG. 4) corresponding to genes that exhibit attenuated expression in gastric cancer patients compared with normal healthy subjects, the expression levels of the genes may be measured. With the use of, from among the 107 probes shown in FIG. 4, at least one of probes No. 7 to No. 107 corresponding to genes that exhibit enhanced expression in gastric cancer patients compared with normal healthy subjects, the expression levels of the genes may be measured. Furthermore, with the use of a combination of at least one of the probes No. 1 to No. 6 and at least one of the probes No. 7 to No. 107, the expression levels of the genes may be measured. At this time, 1, 2, 3, 4, 5, or 6 probes of the probes No. 1 to No. 6 may be used and at least 1, 2, 3, 4, 5, 6, 7, 8, 9, 10, 20, 30, 40, 50, 60, 70, 80, 90, or 100, or 101 probes of the probes No. 7 to No. 107 may be used.

The method for detecting colorectal cancer of the present invention comprises measuring the expression levels of genes in peripheral blood of a subject (described in the rightmost column in FIG. 5) using at least one of 771 probes shown in FIG. 5, wherein the genes correspond to the 771 probes. At this time, with the use of at least 1 to 770 probes from among the 771 probes shown in FIG. 5, specifically at least 1, 2, 3, 4, 5, 6, 7, 8, 9, 10, 50, 100, 150, 200, 250, 300, 350, 400, 450, 500, 550, 600, 650, 700, 750, 770, or 771 probes, the expression levels of the genes corresponding thereto may be measured. Also, with the use of at least one of probes corresponding to genes that exhibit attenuated expression in a group of colorectal cancer patients, the expression level of the gene corresponding thereto may be measured. Also, with the use of at least one of probes corresponding to genes that exhibit enhanced expression in a group of colorectal cancer patients, the expression level of the gene corresponding to the probe may be measured. Furthermore, with the use of a combination of at least one of probes corresponding to genes that exhibit attenuated expression in a group of colorectal cancer patients and at least one of probes corresponding to genes that exhibit enhanced expression in the group of colorectal cancer patients, the expression levels of the genes corresponding to the probes may be measured. Specifically, with the use of at least one of 125 probes (No. 1 to No. 125) (SEQ ID NOs: 1582-1706) shown in FIG. 5, the expression level of at least one of the genes corresponding to the probes may be measured. At this time, with the use of at least 1 to 124 probes from among the 125 probes, specifically at least 1, 2, 3, 4, 5, 6, 7, 8, 9, 10, 20, 30, 40, 50, 60, 70, 80, 90, 100, 110, 120, 124, or 125 probes, the expression levels of the genes corresponding thereto may be measured. Also, with the use of at least one of 646 probes (No. 126 to No. 771) (SEQ ID NOs: 1707-2352) shown in FIG. 5, the expression levels of the genes corresponding thereto may be measured. At this time, with the use of at least 1 to 645 probes from among the 646 probes, specifically at least 1, 2, 3, 4, 5, 6, 7, 8, 9, 10, 50, 100, 150, 200, 250, 300, 350, 400, 450, 500, 550, 600, 645, or 646 probes, the expression levels of the genes corresponding thereto may be measured. Furthermore, with the use of a combination of at least one of the 125 probes (No. 1 to No. 125) (SEQ ID NOs: 1582-1706) shown in FIG. 5 and at least one of the 646 probes (No. 126 to No. 771) (SEQ ID NOs: 1707-2352) shown in FIG. 5, the expression levels of the genes corresponding thereto may be measured.

Furthermore, with the use of at least one of 116 probes shown in FIG. 6 corresponding particularly to genes with expression levels that vary significantly from among the genes corresponding to the above 771 probes, the expression levels of the genes (described in the rightmost column in FIG. 6) corresponding to the probes may be measured. At this time, with the use of the 116 probes, specifically 1, 2, 3, 4, 5, 6, 7, 8, 9, 10, 20, 30, 40, 50, 60, 70, 80, 90, 100, 110, or 115, or 116 probes, the expression levels of the genes corresponding to the probes may be measured. Also, with the use of at least one of probes No. 1 to No. 9 (from among the 116 probes shown in FIG. 6) corresponding to genes that exhibit attenuated expression in colorectal cancer patients compared with normal healthy subjects, the expression levels of the genes may be measured. With the use of, from among the 116 probes shown in FIG. 6, at least one of probes No. 10 to No. 116 corresponding to genes that exhibit enhanced expression in colorectal cancer patients compared with normal healthy subjects, the expression levels of the genes may be measured. Furthermore, with the use of a combination of at least one of the probes No. 1 to No. 9 and at least one of the probes No 10 to No. 116, the expression levels of the genes may be measured. At this time, 1, 2, 3, 4, 5, 6, 7, 8, or 9 probes of the probes No. 1 to No. 9 may be used and at least 1, 2, 3, 4, 5, 6, 7, 8, 9, 10, 20, 30, 40, 50, 60, 70, 80, 90, 100, or 109, or 110 probes of the probes No. 10 to No. 116 may be used.

The method for detecting pancreatic cancer of the present invention comprises measuring the expression levels of genes in peripheral blood of a subject (described in the rightmost column in FIG. 7) using at least one of 677 probes shown in FIG. 7, wherein the genes correspond to the 677 probes. At this time, with the use of at least 1 to 676 probes from among the 677 probes shown in FIG. 7, specifically at least 1, 2, 3, 4, 5, 6, 7, 8, 9, 10, 50, 100, 150, 200, 250, 300, 350, 400, 450, 500, 550, 600, 650, 676, or 677 probes, the expression levels of the genes corresponding thereto may be measured. Also, with the use of at least one of probes corresponding to genes that exhibit attenuated expression in a group of pancreatic cancer patients, the expression level of the gene corresponding thereto may be measured. Also, with the use of at least one of probes corresponding to genes that exhibit enhanced expression in a group of pancreatic cancer patients, the expression level of the gene corresponding to the probe may be measured. Furthermore, with the use of a combination of at least one of probes corresponding to genes that exhibit attenuated expression in a group of pancreatic cancer patients and at least one of probes corresponding to genes that exhibit enhanced expression in the group of pancreatic cancer patients, the expression levels of the genes corresponding to the probes may be measured. Specifically, with the use of at least one of 96 probes (No. 1 to No. 96) (SEQ ID NOs: 2353-2448) shown in FIG. 7, the expression level of at least one of the genes corresponding to the probes may be measured. At this time, with the use of at least 1 to 95 probes from among the 96 probes, specifically at least 1, 2, 3, 4, 5, 6, 7, 8, 9, 10, 20, 30, 40, 50, 60, 70, 80, 90, or 95, or 96 probes, the expression levels of the genes corresponding thereto may be measured. Also, with the use of at least one of 581 probes (No. 97 to No. 677) (SEQ ID NOs: 2449-3029) shown in FIG. 7, the expression levels of the genes corresponding thereto may be measured. At this time, with the use of at least 1 to 580 probes from among the 581 probes, specifically at least 1, 2, 3, 4, 5, 6, 7, 8, 9, 10, 50, 100, 150, 200, 250, 300, 350, 400, 450, 500, 550, or 580, or 581 probes, the expression levels of the genes corresponding thereto may be measured. Furthermore, with the use of a combination of at least one of the 96 probes (No. 1 to No. 96) (SEQ ID NOs: 2353-2448) shown in FIG. 7 and at least one of the 581 probes (No. 97 to No. 677) (SEQ ID NOs: 2449-3029) shown in FIG. 7, the expression levels of the genes corresponding thereto may be measured.

Furthermore, with the use of at least one of 61 probes shown in FIG. 8 corresponding particularly to genes with expression levels that vary significantly (from among the genes corresponding to the above 677 probes), the expression levels of the genes (described in the rightmost column in FIG. 8) corresponding to the probes may be measured. At this time, with the use of the 61 probes, specifically at least 1, 2, 3, 4, 5, 6, 7, 8, 9, 10, 20, 30, 40, 50, or 60, or 61 probes, the expression levels of the genes corresponding to the probes may be measured. Also, with the use of at least one of probes No. 1 to No. 6 (from among the 61 probes shown in FIG. 8) corresponding to genes that exhibit attenuated expression in pancreatic cancer patients compared with normal healthy subjects, the expression levels of the genes may be measured. With the use of, from among the 61 probes shown in FIG. 8, at least one of probes No. 7 to No. 61 corresponding to genes that exhibit enhanced expression in pancreatic cancer patients compared with normal healthy subjects, the expression levels of the genes may be measured. Furthermore, with the use of a combination of at least one of the probes No. 1 to No. 6 and at least one of the probes No. 7 to No. 61, the expression levels of the genes may be measured. At this time, 1, 2, 3, 4, 5, or 6 probes of the probes No. 1 to No. 6 may be used and 1, 2, 3, 4, 5, 6, 7, 8, 9, 10, 20, 30, 40, 50, or 54, or 55 probes of the probes No. 7 to No. 61 may be used.

The method for detecting biliary tract cancer of the present invention comprises measuring the expression levels of genes in peripheral blood of a subject (described in the rightmost column in FIG. 24) using at least one of 363 probes shown in FIG. 24 (FIG. 24-1 to FIG. 24-19), wherein the genes correspond to the 363 probes. At this time, with the use of at least 1 to 362 probes from among the 363 probes shown in FIG. 24, specifically at least 1, 2, 3, 4, 5, 6, 7, 8, 9, 10, 50, 100, 150, 200, 250, 300, 350, or 362, or 363 probes, the expression levels of the genes corresponding thereto may be measured. Also, with the use of at least one of probes corresponding to genes that exhibit attenuated expression in a group of biliary tract cancer patients, the expression level of the gene corresponding thereto may be measured. Also, with the use of at least one of probes corresponding to genes that exhibit enhanced expression in a group of biliary tract cancer patients, the expression level of the gene corresponding to the probe may be measured. Furthermore, with the use of a combination of at least one of probes corresponding to genes that exhibit attenuated expression in a group of biliary tract cancer patients and at least one of probes corresponding to genes that exhibit enhanced expression in the group of biliary tract cancer patients, the expression levels of the genes corresponding to the probes may be measured. Specifically, with the use of at least one of 98 probes (No. 1 to No. 98) (SEQ ID NOs: 3055-3152) shown in FIG. 24, the expression level of at least one of the genes corresponding to the probes may be measured. At this time, with the use of at least 1 to 97 probes from among the 98 probes, specifically at least 1, 2, 3, 4, 5, 6, 7, 8, 9, 10, 20, 30, 40, 50, 60, 70, 80, 90, or 97, or 98 probes, the expression levels of the genes corresponding thereto may be measured. Also, with the use of at least one of 265 probes (No. 99 to No. 363) (SEQ ID NOs: 3153-3417) shown in FIG. 24, the expression levels of the genes corresponding thereto may be measured. At this time, with the use of at least 1 to 264 probes from among the 265 probes, specifically at least 1, 2, 3, 4, 5, 6, 7, 8, 9, 10, 50, 100, 150, 200, 250, 264, or 265 probes, the expression levels of the genes corresponding thereto may be measured. Furthermore, with the use of a combination of at least one of the 98 probes (No. 1 to No. 98) (SEQ ID NOs: 3055-3152) shown in FIG. 24 and at least one of the 265 probes (No. 99 to No. 363) (SEQ ID NOs: 3153-3417) shown in FIG. 24, the expression levels of the genes corresponding thereto may be measured.

The method of the present invention enables identification of a patient with digestive organ cancer, gastric cancer, colorectal cancer, pancreatic cancer, or biliary tract cancer. Specifically, the presence of digestive organ cancer, gastric cancer, colorectal cancer, pancreatic cancer, or biliary tract cancer can be detected.

Subjects may exhibit unknown pathological conditions. When such a subject with unknown pathological conditions is used, whether the subject is normal or affected with digestive organ cancer, gastric cancer, colorectal cancer, pancreatic cancer, or biliary tract cancer can be determined and diagnosed.

In the present invention, the above determination of the pathological conditions of digestive organ cancer, gastric cancer, colorectal cancer, pancreatic cancer, or biliary tract cancer, prognostic prediction, and the like are broadly referred to as detection of digestive organ cancer, gastric cancer, colorectal cancer, pancreatic cancer, or biliary tract cancer.

Furthermore, the pathological conditions of a subject can be determined by obtaining the expression profiles of one or more genes corresponding to the above probes (specifically, 868 probes or 25 probes for digestive organ cancer, 713 probes for gastric cancer, 771 probes for colorectal cancer, 677 probes for pancreatic cancer, and 363 probes for biliary tract cancer) and then analyzing the expression profiles. If expression profiles obtained from a subject are analogous to expression profiles obtained from a digestive organ cancer, gastric cancer, colorectal cancer, pancreatic cancer, or biliary tract cancer patient, the subject can be determined as having digestive organ cancer, gastric cancer, colorectal cancer, pancreatic cancer, or biliary tract cancer. Also, expression profiles obtained from a subject are compared with expression profiles obtained from a normal subject and then evaluation and determination can be made based on a difference in expression profiles between the subject and the normal subject.

Gene expression profiling comprises recording the patterns of expression signals such as fluorescence intensities in the form of digital numerical values or color images. Gene expression profiles can be compared using pattern comparison software. Cox hazard analysis, discriminant analysis, and the like can be used herein. A discriminant analysis model is constructed in advance for evaluation and determination of pathological conditions, prediction of pathological conditions, or prognostic prediction, data concerning gene expression profiles obtained from a subject are input into the discriminant analysis model, and thus determination of pathological conditions, prediction of pathological conditions, or prognostic prediction can also be performed. For example, pathological conditions, prediction of pathological conditions, or prognostic prediction can be evaluated and determined by obtaining a discriminant via discriminant analysis, relating fluorescence intensities to pathological conditions, predicting pathological conditions, or conducting prognostic prediction, and then substituting the numerical value representing the expression signal of the subject into the discriminant.

The present invention encompasses an in vitro diagnostic or a kit for detecting digestive organ cancer, gastric cancer, colorectal cancer, pancreatic cancer, or biliary tract cancer, which contains: nucleotides consisting of the nucleotide sequences of genes with expression levels that vary in digestive organ cancer patients compared with normal healthy subjects, genes with expression levels that vary in gastric cancer patients compared with normal healthy subjects, genes with expression levels that vary in colorectal cancer patients compared with normal healthy subjects, genes with expression levels that vary in pancreatic cancer patients compared with normal healthy subjects, or genes with expression levels that vary in biliary tract cancer patients compared with normal healthy subjects for measurement of the expression levels of these genes, or nucleotides containing partial sequences thereof.

The reagent contains nucleotides consisting of the nucleotide sequences of the above genes or nucleotides containing partial sequences thereof as probes or primers. The reagent is also a substrate such as a micro array on which nucleotides consisting of the nucleotide sequences of the above genes or nucleotides containing partial sequences thereof have been immobilized.

For example, a reagent or a kit for detecting digestive organ cancer contains at least one of the above 868 or 25 probes that can be used for detection of digestive organ cancer and is capable of measuring the expression level of at least one of genes corresponding to the probes. Also, a reagent or a kit for detecting gastric cancer contains at least one of the above 713 probes that can be used for detection of gastric cancer and is capable of measuring the expression level of at least one of genes corresponding to the probes. Also, a reagent or a kit for detecting colorectal cancer contains at least one of the above 771 probes that can be used for detection of colorectal cancer and is capable of measuring the expression level of at least one of genes corresponding to the probes. Moreover, a reagent or a kit for detecting pancreatic cancer contains at least one of 677 probes that can be used for detection of pancreatic cancer, and is capable of measuring the expression level of at least one of genes corresponding to the probes. Furthermore, a reagent or a kit for detecting biliary tract cancer contains at least one of 363 probes that can be used for detection of biliary tract cancer and is capable of measuring the expression level of at least one of genes corresponding to the probes.

The present invention encompasses a system for detecting digestive organ cancer, gastric cancer, colorectal cancer, pancreatic cancer, or biliary tract cancer of a subject by the method for detecting digestive organ cancer, gastric cancer, colorectal cancer, pancreatic cancer, or biliary tract cancer of the present invention.

The system for detecting digestive organ cancer, gastric cancer, colorectal cancer, pancreatic cancer, or biliary tract cancer of the present invention comprises:
(a) a data input means for inputting data concerning the gene expression profiles of a subject (here, the "data concerning gene expression profiles to be input" refers to data representing the expression level of each gene, such as a numerical value for signals in each gene;
(b) a memory means for storing the thus constructed discriminant model;
(c) a data processing means for applying data input using the input means (a) to the discriminant model stored in the memory means (b), and then determining the pathological conditions of digestive organ cancer, gastric cancer, colorectal cancer, pancreatic cancer, or biliary tract cancer; and
(d) a data output means for outputting data concerning the determination of predicted pathological conditions of digestive organ cancer, gastric cancer, colorectal cancer, pancreatic cancer, or biliary tract cancer, prediction of the pathological conditions, and prognostic prediction.

The data input means (a) contains a key board or an external memory device storing data, for example. The memory means (b) contains a hard disk, for example. The data processing means receives a discriminant model from the memory means and processing the input data, sends the processing result to the data output means, and then displaying the processing result with the data output means. The data processing means contains a central processing unit (CPU) and the like for processing data. Also, the output means contains a monitor, a printer, and the like for displaying the results.

The system of the present invention can be constructed using a commercially available personal computer and the like.

EXAMPLES

The present invention will be specifically described using the following examples, but the present invention is not limited to these examples.

Materials and experimental methods employed in the examples are as follows.
Object
Blood samples collected from patients diagnosed by a doctor as having digestive organ cancer, gastric cancer, colorectal cancer, pancreatic cancer, or biliary tract cancer were designated as a digestive organ cancer case, a gastric cancer case, a colorectal cancer case, a pancreatic cancer case, and a biliary tract cancer case, respectively. Regarding a control group, blood samples provided with the consent of patients who had received health checkups for residents held by local governments and consented to provide their blood were used herein. Blood samples were examined through a search for the following test items, and patients who exhibited normal values were designated as normal healthy subjects.

Test items: systolic blood pressure, diastolic blood pressure, number of erythrocytes, number of leukocytes, hemoglobin value, hematocrit value, liver functions (GOT, GPT, γ-GTP), renal functions (creatinine value), lipid metabolism (LDL cholesterol value, HDL cholesterol value, total cholesterol value), protein in urine, urinary blood
Collection of Peripheral Blood:
Peripheral blood was collected from patients using PAXgene™ RNA blood collecting tube (Becton, Dickinson and Company, Japan, Medical Device Marketing Authorization No. (Iryo-kiki Seizo Hanbai Ninsho No.): 218AFBZX00014000).
RNA Extraction and Hybridization
RNA was extracted via a PAXgene™ RNA blood collecting tube according to protocols using a PAXgene Blood RNA Kit (QIAGEN GmbH, Hilden, Germany). RNA was amplified based on the thus extracted RNA using a QuickAmp Labeling Kit, 1 color (Agilent Technologies, Santa Clara, Calif.), and at the same time labeled with a Cy3 dye. The thus labeled RNA was mixed using a Gene Expression Hybridization Kit (Agilent Technologies, Santa Clara, Calif.), followed by hybridization to Whole Human Genome oligo DNA microarrays (Agilent Technologies, Santa Clara, Calif.). In addition, the process from RNA amplification to hybridization was performed according to experimental protocols disclosed by Agilent Technologies.
Image Analysis and Data Analysis of DNA Microarrays:
The fluorescence intensity of each spot on the oligo DNA microarrays was acquired using a DNA microarray scanner (Agilent Technologies, Santa Clara, Calif.). The thus acquired images were processed with Feature Extraction software (Agilent Technologies, Santa Clara, Calif.), so that the fluorescence intensity of each spot was quantitated. The fluorescence intensity of a probe at each spot was calculated by quantitation.

The numerical values of the fluorescence intensities of all probes on the microarrays were normalized using GeneSpring GX (Agilent Technologies, Santa Clara, Calif.). A quality check was performed for the fluorescence intensity of each probe based on the thus normalized numerical value representing the enhanced or attenuated expression of each probe. Only probes that had passed the quality check were subjected as analytical objects to hierarchical clustering. Also, similarly, with the use of GeneSpring GX, genes with expression levels that were observed to differ between the digestive organ cancer patient group and the normal healthy subject group, were examined using Welch t-test as a statistic analysis tool. Candidate probes were extracted using the Benjamini and Hochberg False Discovery Rate as a multiple test and $p<0.05$ as significant value. Furthermore, similarly, with the use of GeneSpring GX, predictive determination was performed to determine if a subject belonged to a cancer case group or a normal healthy subject group (differing from the cancer case group or the normal healthy subject group used for extraction of candidate probes) using a class prediction tool and support vector machines for calculation.

The following results were obtained from the examples.
1. Detection of Digestive Organ Cancer (1)
Hierarchical Clustering:
Hierarchical clustering was performed using a GeneSpring GX hierarchical clustering tool and 23352 probes that had passed a quality check. As shown in FIG. 9, 5 clusters were formed. In the $1^{st}$ cluster, 3 out of 3 cases (100%) were digestive organ cancer cases. In the $2^{nd}$ cluster, 8 out of 9 cases (88.9%) were digestive organ cancer cases. In the $3^{rd}$ cluster, 5 out of 6 cases (83.3%) and in the $4^{th}$ cluster, 9 out of 10 cases (90.0%) were digestive organ cancer cases. In the $5^{th}$ cluster, 3 out of 4 cases (75.0%) were digestive organ cancer cases. Hence, digestive organ cancer cases and normal healthy subjects were separately clustered.

Genes with expression levels that were observed to differ between a digestive organ cancer case group and a normal healthy subject group:
Similarly, with the use of a GeneSpring GX Statistic Analysis tool, probes capable of discriminating between a digestive organ cancer case group and a normal healthy subject group were examined using the Benjamini and Hochberg false discovery rate for a multiple test and $p<0.0005$. As a result, the expression of 868 probes was observed to differ between the two groups.

Also, normalized numerical values for fluorescence intensities of the 868 probes were compared using a Fold Change tool between the digestive organ cancer case group and the normal healthy subject group. The expression of 555 probes was observed to be attenuated regardless of multiplying factor, and the expression of 313 probes was observed to be enhanced regardless of multiplying factor, in the digestive organ cancer case group, compared with normal healthy subjects. Also, the expression of 6 probes was observed to be attenuated at levels 0.4 times or less that of the normal healthy subject group and the expression of 15 probes was observed to be enhanced at levels 2.5 times or more that of the normal healthy subject group.

Hierarchical Clustering with 868 Probes Corresponding to Genes with Expression Levels that were Observed to be Attenuated or Enhanced in Digestive Organ Cancer Cases Compared with Normal Healthy Subjects:

Hierarchical clustering was performed for subject cancer cases and normal healthy subjects using a total of 868 probes including the above 555 probes and 313 probes. As shown in FIG. 10, 3 clusters were formed. In the $1^{st}$ cluster, 14 out of 14 cases (100%) were digestive organ cancer cases. In the $2^{nd}$ cluster, 8 out of 8 cases (100%) were digestive organ cancer cases. In the $3^{rd}$ cluster, 8 out of 10 cases (80%) were normal healthy subject cases. Thus, digestive organ cancer cases and normal healthy subjects were separately clustered.

Predictive Determination Using 868 Probes Corresponding to Genes With Expression Levels that were Observed to be Attenuated or Enhanced in Digestive Organ Cancer Cases Compared with Normal Healthy Subjects:

Similarly with the use of a GeneSpring GX Class Prediction tool, a prediction model was prepared based on 868 probes with expression levels that were observed to differ, using Support Vector Machines. The prediction model was applied to a cancer case group and a normal healthy subject group (separate from the cancer case group and the normal healthy subject group used for probe extraction and preparation of the prediction model) for which image analysis and data analysis had been performed for DNA microarrays by similar procedures. Thus, the probability of determining cancer cases to be cancer cases and the probability of determining normal healthy subjects to be normal healthy subjects were found. As a result, 39 out of 40 separately analyzed cancer cases were determined with the prediction model to be cancer cases and the probability that such cases had been properly diagnosed was 97.5%. Also, 9 out of 13 normal healthy subject cases were determined with prediction model to be normal healthy subjects, and the probability that such cases had been properly diagnosed was 69.2%. Altogether, 48 out of 53 such cases were correct answers. Thus, the percentage of cases determined correctly was 90.6% ($^{48}/_{53}$).

Hierarchical Clustering with 21 Probes Corresponding to Genes with Expression Levels that were Observed to be Attenuated at Levels 0.4 Times or Less the Normal Healthy Subject Group or Enhanced at Levels 2.5 Times or More the Normal Healthy Subject Group:

Hierarchical clustering was performed using a total of 21 probes including the above 6 probes and 15 probes for subject cancer cases and normal healthy subjects. As shown in FIG. 11, 3 clusters were formed. In the $1^{st}$ cluster, 17 out of 17 cases (100%) were digestive organ cancer cases. In the $2^{nd}$ cluster, 7 out of 9 cases (77.8%) were digestive organ cancer eases. In the $3^{rd}$ cluster, 6 out of 6 cases (100%) were normal healthy subject cases. Thus, digestive organ cancer cases and normal healthy subjects were separately clustered.

Predictive Determination Using 21 Probes Corresponding to Genes with Expression Levels that were Observed to be Attenuated at Levels 0.4 Times or Less the Normal Healthy Subject Group or Enhanced at Levels 2.5 Times or More the Normal Healthy Subject Group:

Similarly, with the use of a GeneSpring GX Class Prediction tool, a prediction model was prepared based on 21 probes observed to exhibit differences in expression, using Support Vector Machines. The prediction model was applied to a cancer case group and a normal healthy subject group (separate from the cancer case group and the normal healthy subject group used for probe extraction and preparation of the prediction model) for which image analysis and data analysis had been performed for DNA microarrays by similar procedures. Thus, the probability of determining cancer cases to be cancer cases and the probability of determining normal healthy subjects to be normal healthy subjects were found. As a result, 37 out of 40 separately analyzed cancer cases were determined with the prediction model to be cancer cases and the probability that such cases had been properly diagnosed was 92.5%. Also, 12 out of 13 normal healthy subjects were determined with the prediction model to be normal healthy subjects, and the probability that such cases had been properly diagnosed was 92.3%. Altogether, 49 out of 53 such cases were correct answers. Thus, the percentage of cases determined correctly was 92.5% ($^{49}/_{53}$).

1-2. Detection of Digestive Organ Cancer (2)

In a manner similar to that in the above detection of digestive organ cancer (1), 39 cancer cases and 15 normal healthy subject cases were examined using a GeneSpring GX hierarchical clustering tool and 23278 probes that had passed a quality check. As shown in FIG. 22, 5 clusters were formed. In the $1^{st}$ cluster, 5 out of 5 cases (100%) were digestive organ cancer cases. In the $2^{nd}$ cluster, 29 out of 30 cases (96.7%) were digestive organ cancer cases. In the $3^{rd}$ cluster, 1 out of 1 case (100%) and in the $4^{th}$ cluster, 6 out of 10 cases (60%) were digestive organ cancer cases. In the $5^{th}$ cluster, 8 out of 8 cases (100%) were normal healthy subject cases. Thus, the digestive organ cancer cases and the normal healthy subjects were separately clustered.

Furthermore, in a manner similar to that in the above detection of digestive organ cancer (1), probes capable of discriminating between a group of 39 digestive organ cancer cases and a group of 15 normal healthy subject cases were examined using a GeneSpring GX Statistic Analysis tool. Probes were extracted using Benjamini and Hochberg False Discovery Rate as a multiple test and p<0.000005. The normalized numerical values of fluorescence intensities of the thus extracted probes were compared between the group of digestive organ cancer cases and the group of normal healthy subjects using a Fold Change tool. Thus, the expression of 14 probes was observed to be attenuated at levels 0.33 times or less that of the normal healthy subject group and the expression of 11 probes was observed to be enhanced at levels 3 times or more that of the normal healthy subject group (FIG. 21, SEQ ID NOs: 3030-3054).

Hierarchical Clustering with 25 Probes Corresponding to Genes with Expression Levels that were Observed to be Attenuated or Enhanced in Digestive Organ Cancer Cases Compared with Normal Healthy Subjects:

Hierarchical clustering was performed using a total of 25 probes including the above 14 probes and 11 probes for subject cancer cases and normal healthy subjects. As shown in FIG. 23, 3 clusters were formed. In the $1^{St}$ cluster, 31 out of 31 cases (100%) were digestive organ cancer cases. In the $2^{nd}$ cluster, 6 out of 6 cases (100%) were digestive organ cancer cases. In the $3^{rd}$ cluster, 15 out of 17 cases (88.2%) were normal healthy subject cases. Thus, the digestive organ cancer cases and the normal healthy subjects were separately clustered.

Predictive Determination Using 25 Probes Corresponding to Genes with Expression Levels that were Observed to be Attenuated or Enhanced in Digestive Organ Cancer Cases Compared with Normal Healthy Subjects:

Similarly, with the use of a GeneSpring GX Class Prediction tool, a prediction model was prepared based on 25 probes observed to exhibit differences in expression, using Support Vector Machines. The prediction model was applied to cancer case group and a normal healthy subject group (separate from the cancer case group and the normal healthy subject group used for probe extraction and preparation of the prediction model) for which image analysis and data analysis had been performed for DNA microarrays by similar procedures. Thus, the probability of determining cancer cases to be cancer cases and the probability of determining normal healthy subjects to be normal healthy subjects were found. As a result, 3.7 out of 37 separately analyzed cancer cases were determined with the prediction model to be cancer cases and the probability that such cases had been properly diagnosed was 100%. Also, 11 out of 15 normal healthy subjects were determined with the prediction model to be normal healthy subjects, and the probability that such cases had been properly diagnosed was 73.3%. Altogether, 48 out of 52 such cases were correct answers. Thus, the percentage of cases determined correctly was 92.3% (48/52).

2. Detection of Gastric Cancer

Hierarchical Clustering:

Hierarchical clustering was performed using a GeneSpring GX hierarchical clustering tool and 22155 probes that had passed a quality check. As shown in FIG. 12, 4 clusters were formed. In the $1^{st}$ cluster, 6 out of 6 cases (100%) were gastric cancer cases. In the $2^{nd}$ cluster, 3 out of 4 cases (75%) were normal healthy subject cases. In the $3^{rd}$ cluster, 3 out of 4 cases (75%) and in the $4^{th}$ cluster, 2 out of 2 cases (100%) were normal healthy subject cases. Hence, gastric cancer cases and normal healthy subjects were separately clustered.

Genes with Expression Levels that were Observed to Differ Between a Gastric Cancer Case Group and a Normal Healthy Subject Group:

Similarly, with the use of a GeneSpring GX Statistic Analysis tool, probes capable of discriminating between a gastric cancer case group and a normal healthy subject group were examined using the Benjamini and Hochberg false discovery rate for a multiple test and $p<0.05$. As a result, the expression of 3453 probes was observed to differ between the two groups.

Also, normalized numerical values for fluorescence intensities of the 3453 probes were compared using a Fold Change tool between the gastric cancer case group and the normal healthy subject group. The expression of 84 probes was observed to be attenuated in the gastric cancer case group at levels 0.5 times or less that of the normal healthy subject group and the expression of 629 probes was observed to be enhanced in the gastric cancer case group at levels 2 times or more that of the normal healthy subject group. Also, the expression of 6 probes was observed to be attenuated in the gastric cancer case group at levels 0.33 times or less that of the normal healthy subject group and the expression of 101 probes was observed to be enhanced in the gastric cancer case group at levels 3 times or more that of the normal healthy subject group.

Hierarchical Clustering with 713 Probes Corresponding to Genes with Expression Levels that were Observed to be Attenuated at Levels 0.5 Times or Less or Enhanced at Levels 2 Times or More that of the Normal Healthy Subject Group:

Hierarchical clustering was performed for subject cancer cases and normal healthy subjects using a total of 713 probes including the above 84 probes and 629 probes. As shown in FIG. 13, 2 clusters were formed, in which a cluster of cancer cases accounting for 100% and a cluster of normal healthy subject cases accounting for 100%.

Predictive Determination Using 713 Probes Corresponding to Genes with Expression Levels that were Observed to be Attenuated at Levels 0.5 Times or Less or Enhanced at Levels 2 Times or More that of the Normal Healthy Subject Group:

Similarly with the use of a GeneSpring GX Class Prediction tool, a prediction model was prepared based on 713 probes with expression levels that were observed to differ, using Support Vector Machines. The prediction model was applied to a cancer case group and a normal healthy subject group (separate from the cancer case group and the normal healthy subject group used for probe extraction and preparation of the prediction model) for which image analysis and data analysis had been performed for DNA microarrays by similar procedures. Thus, the probability of determining cancer cases to be cancer cases and the probability of determining normal healthy subjects to be normal healthy subjects were found. As a result, 7 out of 10 separately analyzed cancer cases were determined with the prediction model to be cancer cases and the probability that such cases had been properly diagnosed was 70%. Also, 13 out of 13 normal healthy subject cases were determined with prediction model to be normal healthy subject cases, and the probability that such cases had been properly diagnosed was 100%. Altogether, 20 out of 23 such cases were correct answers. Thus, the percentage of cases determined correctly was 87.0% (20/23).

Hierarchical Clustering with 107 Probes Corresponding to Genes with Expression Levels that were Observed to be Attenuated at Levels 0.33 Times or Less or Enhanced at Levels 3 Times or More that of the Normal Healthy Subject Group:

Hierarchical clustering was performed for subject cancer cases and normal healthy subjects using a total of 107 probes including the above 6 probes and 101 probes. As shown in FIG. 14, 2 clusters were formed, in which a cluster of cancer cases accounting for 100% and a cluster of normal healthy subject cases accounting for 100%.

Predictive Determination Using 107 Probes Corresponding to Genes with Expression Levels that were Observed to be Attenuated at Levels 0.33 Times or Less or Enhanced at Levels 3 Times or More that of the Normal Healthy Subject Group:

Similarly with the use of a GeneSpring GX Class Prediction tool, a prediction model was prepared based on 107 probes with expression levels that were observed to differ, using Support Vector Machines. The prediction model was applied to a cancer case group and a normal healthy subject group (separate from the cancer case group and the normal healthy subject group used for probe extraction and preparation of the prediction model) for which image analysis and data analysis had been performed for DNA microarrays by similar procedures. Thus, the probability of determining cancer cases to be cancer cases and the probability of determining normal healthy subjects to be normal healthy subjects were found. As a result, 8 out of 10 separately analyzed cancer cases were determined with the prediction model to be cancer cases and the probability that such cases had been properly diagnosed was 80%. Also, 13 out of 13 normal healthy subject cases were determined with prediction model to be normal healthy subject cases, and the probability that such cases had been properly diagnosed was 100%. Altogether, 21 out of 23 such cases were correct answers. Thus, the percentage of cases determined correctly was 91.3% (21/23).

3. Detection of Colorectal Cancer

Hierarchical Clustering:

Hierarchical clustering was performed using a GeneSpring GX hierarchical clustering tool and 22181 probes that had passed a quality check. As shown in FIG. 15, 3 clusters were formed. In the $1^{st}$ cluster, 4 out of 5 cases (80%) were colorectal cancer cases. In the $2^{nd}$ cluster, 6 out of 7 cases (85.7%) were normal healthy subject cases. In the $3^{rd}$ cluster, 3 out of 4 cases (75%) were colorectal cancer cases. Hence, colorectal cancer cases and normal healthy subjects were separately clustered.

Genes with Expression Levels that were Observed to Differ Between a Colorectal Cancer Case Group and a Normal Healthy Subject Group:

Similarly, with the use of a GeneSpring GX Statistic Analysis tool, probes capable of discriminating between a colorectal cancer case group and a normal healthy subject group were examined using the Benjamini and Hochberg false discovery rate for a multiple test and p<0.05. As a result, the expression of 5267 probes was observed to differ between the two groups.

Also, normalized numerical values for fluorescence intensities of the 5267 probes were compared using a Fold Change tool between the colorectal cancer case group and the normal healthy subject group. The expression of 125 probes was observed to be attenuated in the large bowel case group at levels 0.5 times or less that of the normal healthy subject group and the expression of 646 probes was observed to be enhanced in the colorectal cancer case group at levels 2 times or more that of the normal healthy subject group. Also, the expression of 9 probes was observed to be attenuated in the colorectal cancer case group at levels 0.33 times or less that of the normal healthy subject group and the expression of 107 probes was observed to be enhanced in the colorectal cancer case group at levels 3 times or more that of the normal healthy subject group.

Hierarchical Clustering with 771 Probes Corresponding to Genes with Expression Levels that were Observed to be Attenuated at Levels 0.5 Times or Less or Enhanced at Levels 2 Times or More that of the Normal Healthy Subject Group:

Hierarchical clustering was performed for subject cancer cases and normal healthy subjects using a total of 771 probes including the above 125 probes and 646 probes. As shown in FIG. 16, 3 clusters were formed. In the $1^{st}$ cluster, 5 out of 5 cases (100%) were colorectal cancer cases. In the $2^{nd}$ cluster, 3 out of 5 cases (60.0%) were colorectal cancer cases. In the $3^{rd}$ cluster, 7 out of 7 cases (100%) were normal healthy subject cases.

Predictive Determination Using 771 Probes Corresponding to Genes with Expression Levels that were Observed to be Attenuated at Levels 0.5 Times or Less or Enhanced at Levels 2 Times or More that of the Normal Healthy Subject Group:

Similarly with the use of a GeneSpring GX Class Prediction tool, a prediction model was prepared based on 771 probes with expression levels that were observed to differ, using Support Vector Machines. The prediction model was applied to a cancer case group and a normal healthy subject group (separate from the cancer case group and the normal healthy subject group used for probe extraction and preparation of the prediction model) for which image analysis and data analysis had been performed for DNA microarrays by similar procedures. Thus, the probability of determining cancer cases to be cancer cases and the probability of determining normal healthy subjects to be normal healthy subjects were found. As a result, 9 out of 10 separately analyzed cancer cases were determined with the prediction model to be cancer cases and the probability that such cases had been properly diagnosed was 90%. Also, 13 out of 13 normal healthy subject cases were determined with prediction model to be normal healthy subject cases, and the probability that such cases had been properly diagnosed was 100%. Altogether, 22 out of 23 such cases were correct answers. Thus, the percentage of cases determined correctly was 95.7% ($^{22}/_{23}$).

Hierarchical Clustering with 116 Probes Corresponding to Genes with Expression Levels that were Observed to be Attenuated at Levels 0.33 Times or Less or Enhanced at Levels 3 Times or More that of the Normal Healthy Subject Group:

Hierarchical clustering was performed using a total of 116 probes including the above 9 probes and 107 probes for subject cancer cases and normal healthy subjects. As shown in FIG. 17, 3 clusters were formed. In the $1^{st}$ cluster, 5 out of 5 cases (100%) were colorectal cancer cases. In the $2^{nd}$ cluster, 3 out of 6 cases (50.0%) were colorectal cancer cases. In the $3^{rd}$ cluster, 5 out of 5 cases (100%) were normal healthy subject cases.

Predictive Determination Using 116 Probes Corresponding to Genes with Expression Levels that were Observed to be Attenuated at Levels 0.33 Times or Less or Enhanced at Levels 3 Times or More that of the Normal Healthy Subject Group:

Similarly with the use of a GeneSpring GX Class Prediction tool, a prediction model was prepared based on 116 probes with expression levels that were observed to differ, using Support Vector Machines. The prediction model was applied to a cancer case group and a normal healthy subject group (separate from the cancer case group and the normal healthy subject group used for probe extraction and preparation of the prediction model) for which image analysis and data analysis had been performed for DNA microarrays by similar procedures. Thus, the probability of determining cancer cases to be cancer cases and the probability of determining normal healthy subjects to be normal healthy subjects were found. As a result, 9 out of 10 separately analyzed cancer cases were determined with the prediction model to be cancer cases and the probability that such cases had been properly diagnosed was 90%. Also, 13 out of 13 normal healthy subject cases were determined with prediction model to be normal healthy subject cases, and the probability that such cases had been properly diagnosed was 100%. Altogether, 22 out of 23 such cases were correct answers. Thus, the percentage of cases determined correctly was 95.7% ($^{22}/_{23}$).

4. Detection of Pancreatic Cancer

Hierarchical Clustering:

Hierarchical clustering was performed using a GeneSpring GX hierarchical clustering tool and 22149 probes that had passed a quality check. As shown in FIG. 18, 3 clusters were formed. In the $1^{st}$ cluster, 7 out of 7 cases (100%) were normal healthy subject cases. In the $2^{nd}$ cluster, 4 out of 5 cases (80%) were pancreatic cancer cases. In the $3^{rd}$ cluster, 4 out of 4 cases (100%) were pancreatic cancer cases. Hence, pancreatic cancer cases and normal healthy subjects were separately clustered.

Genes with Expression Levels that were Observed to Differ Between a Pancreatic Cancer Case Group and a Normal Healthy Subject Group:

Similarly, with the use of a GeneSpring GX Statistic Analysis tool, probes capable of discriminating between a pancreatic cancer case group and a normal healthy subject group were examined using the Benjamini and Hochberg false discovery rate for a multiple test and p<0.05. As a result, the expression of 3301 probes was observed to differ between the two groups.

Also, normalized numerical values for fluorescence intensities of the 3301 probes were compared using a Fold Change tool between the pancreatic cancer case group and the normal healthy subject group. The expression of 96 probes was observed to be attenuated in the pancreatic cancer case group at levels 0.5 times or less that of the normal healthy subject group and the expression of 581 probes was observed to be enhanced in the pancreatic cancer case group at levels 2 times or more that of the normal healthy subject group. Also, the expression of 6 probes was observed to be attenuated in the pancreatic cancer case group at levels 0.33 times or less that of the normal healthy subject group and the expression of 55 probes was observed to be enhanced in the pancreatic cancer case group at levels 3 times or more that of the normal healthy subject group.

Hierarchical Clustering with 677 Probes Corresponding to Genes with Expression Levels that were Observed to be Attenuated at Levels 0.5 Times or Less or Enhanced at Levels 2 Times or More that of the Normal Healthy Subject Group:

Hierarchical clustering was performed for subject cancer cases and normal healthy subjects using a total of 677 probes including the above 96 probes and 581 probes. As shown in FIG. 19, 2 clusters were formed. In the $1^{st}$ cluster, 8 out of 9 cases (88.9%) were normal healthy subject cases. In the $2^{nd}$ cluster, 7 out of 7 cases (100%) were pancreatic cancer cases.

Predictive Determination Using 677 Probes Corresponding to Genes with Expression Levels that were Observed to be Attenuated at Levels 0.5 Times or Less or Enhanced at Levels 2 Times or More that of the Normal Healthy Subjects:

Similarly with the use of a GeneSpring GX Class Prediction tool, a prediction model was prepared based on 677 probes with expression levels that were observed to differ, using Support Vector Machines. The prediction model was applied to a cancer case group and a normal healthy subject group (separate from the cancer case group and the normal healthy subject group used for probe extraction and preparation of the prediction model) for which image analysis and data analysis had been performed for DNA microarrays by similar procedures. Thus, the probability of determining cancer cases to be cancer cases and the probability of determining normal healthy subjects to be normal healthy subjects were found. As a result, 15 out of 20 separately analyzed cancer cases were determined with the prediction model to be pancreatic cancer cases and the probability that such cases had been properly diagnosed was 75%. Also, 13 out of 13 normal healthy subject cases were determined with prediction model to be normal healthy subject cases, and the probability that such cases had been properly diagnosed was 100%. Altogether, 28 out of 33 such cases were correct answers. Thus, the percentage of cases determined correctly was 84.8% ($^{28}/_{33}$).

Hierarchical Clustering with 61 Probes Corresponding to Genes with Expression Levels that were Observed to be Attenuated at Levels 0.33 Times or Less or Enhanced at Levels 3 Times or More that of the Normal Healthy Subject Group:

Hierarchical clustering was performed for subject cancer cases and normal healthy subjects using a total of 61 probes including the above 6 probes and 5.5 probes. As shown in FIG. 20, 2 clusters were formed. In the $1^{st}$ cluster, 8 out of 9 cases (88.9%) were normal healthy subject cases. In the $2^{nd}$ cluster, 7 out of 7 cases (100%) were pancreatic cancer cases.

Predictive Determination Using 61 Probes Corresponding to Genes with Expression Levels that were Observed to be Attenuated at Levels 0.33 Times or Less or Enhanced at Levels 3 Times or More that of the Normal Healthy Subjects:

Similarly with the use of a GeneSpring GX Class Prediction tool, a prediction model was prepared based on 61 probes with expression levels that were observed to differ, using Support Vector Machines. The prediction model was applied to a cancer case group and a normal healthy subject group (separate from the cancer case group and the normal healthy subject group used for probe extraction and preparation of the prediction model) for which image analysis and data analysis had been performed for DNA microarrays by similar procedures. Thus, the probability of determining cancer cases to be cancer cases and the probability of determining normal healthy subjects to be normal healthy subjects were found. As a result, 15 out of 20 separately analyzed cancer cases were determined with the prediction model to be pancreatic cancer cases and the probability that such cases had been properly diagnosed was 75%. Also, 9 out of 13 normal healthy subject cases were determined with prediction model to be normal healthy subject cases, and the probability that such cases had been properly diagnosed was 69.2%. Altogether, 24 out of 33 such cases were correct answers. Thus, the percentage of cases determined correctly was 72.7% ($^{24}/_{33}$).

5. Detection of Biliary Tract Cancer

Hierarchical Clustering

Hierarchical clustering was performed using a GeneSpring GX hierarchical clustering tool and 22066 probes that had passed a quality check. As shown in FIG. 25, 3 clusters were formed. In the $1^{st}$ cluster, 7 out of 7 cases (100%) were normal healthy subject cases. In the $2^{nd}$ cluster, 3 out of 3 cases (100%) were biliary tract cancer cases. In the $3^{rd}$ cluster, 5 out of 6 cases (83.3%) were biliary tract cancer cases. Hence, biliary tract cancer cases and normal healthy subjects were separately clustered.

Genes with Expression Levels that were Observed to Differ Between a Biliary Tract Cancer Case Group and a Normal Healthy Subject Group:

Similarly, with the use of a GeneSpring GX Statistic Analysis tool, probes capable of discriminating between a biliary tract cancer case group and a normal healthy subject group were examined using the Benjamini and Hochberg false discovery rate for a multiple test and p<0.05. As a result, the expression of 8090 probes was observed to differ between the two groups.

Also, normalized numerical values for fluorescence intensities of the 8090 probes were compared using a Fold Change tool between the biliary tract cancer case group and the normal healthy subject group. The expression of 98 probes was observed to be attenuated in the biliary tract cancer case group at levels 0.33 times or less that of the normal healthy subject group and the expression of 265 probes was observed to be enhanced in the biliary tract cancer case group at levels 3 times or more that of the normal healthy subject group.

Hierarchical Clustering with 363 Probes Corresponding to Genes with Expression Levels that were Observed to be Attenuated at Levels 0.33 Times or Less or Enhanced at Levels 3 Times or More that of the Normal Healthy Subject Group:

Hierarchical clustering was performed for subject cancer cases and normal healthy subjects using a total of 363 probes including the above 98 probes and 265 probes. As shown in FIG. 26, 2 clusters were formed. In the $1^{St}$ cluster, 7 out of 7 cases (100%) were normal healthy subject cases. In the $2^{nd}$ cluster, 8 out of 9 cases (88.9%) were biliary tract cancer cases.

Predictive Determination Using 363 Probes Corresponding to Genes With Expression Levels that were Observed to be Attenuated at Levels 0.33 Times or Less or Enhanced at Levels 3 Times or More that of the Normal Healthy Subjects:

Similarly with the use of a GeneSpring GX Class Prediction tool, a prediction model was prepared based on 363 probes with expression levels that were observed to differ, using Support Vector Machines. The prediction model was applied to a cancer case group and a normal healthy subject group (separate from the cancer case group and the normal healthy subject group used for probe extraction and preparation of the prediction model) for which image analysis and data analysis had been performed for DNA microarrays by similar procedures. Thus, the probability of determining cancer cases to be cancer cases and the probability of determining normal healthy subjects to be normal healthy subjects were found. As a result, 8 out of 8 separately analyzed cancer cases were determined with the prediction model to be cancer cases and the probability that such cases had been properly diagnosed was 100%. Also, 13 out of 13 normal healthy subject cases were determined with prediction model to be normal healthy subject cases, and the probability that such cases had been properly diagnosed was 100%. Altogether, 21 out of 21 such cases were correct answers. Thus, the percentage of cases determined correctly was 100% (21/21).

All publications, patents, and patent applications cited in this description are herein incorporated by reference in their entirety.

SEQUENCE LISTING (3417 sequences)

SEQ ID NO: 1 - DNA, 60 bp, Homo sapiens
tgaatctttttatgagacaagctgaatctgggatctcaaattgcctctgaccttttataa

SEQ ID NO: 2 - DNA, 60 bp, Homo sapiens
gtatttgagctggggaatttgaatattgtgagtttcagatgttggaaatttgggattttg

SEQ ID NO: 3 - DNA, 60 bp, Homo sapiens
caggaccgtgcagcatataaagagtacatctccaataaacgtaagagcatgaccaagctg

SEQ ID NO: 4 - DNA, 60 bp, Homo sapiens
tagttccctttttccggtcggtctgcgatgagctgaggccagagccatgagaatctgctc

SEQ ID NO: 5 - DNA, 60 bp, Homo sapiens
acaggtctcgcacccacaagtactatctgctgcagagatcctctcatctgtggccaggca

SEQ ID NO: 6 - DNA, 60 bp, Homo sapiens
tccctaccaatgactcacctgaagtgcaatacgaaataaaaggccagcgggcggcgtctg

SEQ ID NO: 7 - DNA, 60 bp, Homo sapiens
ggggtacatggtatggagtagacatcaacaacgaggacattgctgacaactttgaagctt

SEQ ID NO: 8 - DNA, 60 bp, Homo sapiens
tttttctcgtcgcttgccaatctgttttttaaaggatcaggctcgtagggagcaggatca

SEQ ID NO: 9 - DNA, 60 bp, Homo sapiens
tgggctcatagacgcttcacagagcctgcagggcagctgtacacccagcagaggactcca

SEQ ID NO: 10 - DNA, 60 bp, Homo sapiens
aagatggaggccacacccttcaagtggttcatggagatgtgtgtccgaggctacctggct

SEQ ID NO: 11 - DNA, 60 bp, Homo sapiens
ccaattgtgatgatcctttttgctcatttcccagcctttcttgctgttaggggctaccat

SEQ ID NO: 12 - DNA, 60 bp, Homo sapiens
ctgtaacattcatctccattttttaaaaaaggtttctctgacggccccacggcccgagcc

SEQ ID NO: 13 - DNA, 60 bp, Homo sapiens
acagcctgtgggccgcttctttgggaatacctgggcagagatgtacaggaatcgctactg

SEQ ID NO: 14 - DNA, 60 bp, Homo sapiens
actgccactttctgcagctctacctgtggcgttttgtggccgacgaagaactcgtgcact

SEQ ID NO: 15 - DNA, 60 bp, Homo sapiens
aaggcctttgaggttgtgactgtggctggtatatctggctgccatttttctgatgcattt

SEQ ID NO: 16 - DNA, 60 bp, Homo sapiens
ctattgcagattttcatcccattctactgcttgattgaccatcaactccatcctatcgag

SEQ ID NO: 17 - DNA, 60 bp, Homo sapiens
tattgactggtttgatggtaaagaattctccggaaatcctatcaaggtctcatttgctac

SEQ ID NO: 18 - DNA, 60 bp, Homo sapiens
aggctctgttcctcaatggccttttgctacgtgcctcccgagaaatttgtctttttgtat

SEQ ID NO: 19 - DNA, 60 bp, Homo sapiens
tgccctggaatgggtgttgctcttaggatgtatcccctcaaacctacctggtggttctgt

SEQ ID NO: 20 - DNA, 60 bp, Homo sapiens
ctgtgtggagagcatgcatcaggtggaagaagactacctgtttgaaaaagcagaagtcaa

SEQ ID NO: 21 - DNA, 60 bp, Homo sapiens
tgatggaacgctgcatccacttgttgtcagataaaaatctgcaaatccgcctgaaggtct

SEQ ID NO: 22 - DNA, 60 bp, Homo sapiens
cattgaggacttcttcctagagcatgaagctcttggtatttccatggccaaggtactgat

SEQ ID NO: 23 - DNA, 60 bp, Homo sapiens
tgggtgggctctcagattcagctctgtgtaaagattctctagcgggctgcgctcccaagt

SEQ ID NO: 24 - DNA, 60 bp, Homo sapiens
agctgaccctagcactggctgtgacatgctgcttggtgctgcctctggtcctgaggggtt

SEQ ID NO: 25 - DNA, 60 bp, Homo sapiens
gagtgtcggctgtgaaatctgcaaaaagagctgacattccagctgctgtgatcatgaatt

SEQ ID NO: 26 - DNA, 60 bp, Homo sapiens
ttggggcatgacccagcctatggtttgccatactccctctttttctccgttttttcatta

SEQ ID NO: 27 - DNA, 60 bp, Homo sapiens
ctggggcagatgtccttggagttctaccagaagaagaagtctcgctggccattctcagac

SEQ ID NO: 28 - DNA, 60 bp, Homo sapiens
agtcactgctgacaccatctctcccagcagtcttggggtctgggtgggaaacattggtct

SEQ ID NO: 29 - DNA, 60 bp, Homo sapiens
gacaaatcaacacgtaatgagttccgaaggttcatggagaagaatccagatgcctacgat

SEQ ID NO: 30 - DNA, 60 bp, Homo sapiens
aaatcccttttgtgagcctgtgtttgttagatacccaaatggtggtcttgtgcacaccca

SEQ ID NO: 31 - DNA, 60 bp, Homo sapiens
accttgtatggccaaaggggctttgcagatgtaatgaagttaaggatctttcgccaggaa

SEQ ID NO: 32 - DNA, 60 bp, Homo sapiens
ttttcctcccagtcattgaaacaccaaaactattataccggagggtgtaatagttttgct

SEQ ID NO: 33 - DNA, 60 bp, Homo sapiens
tttatgtttttgaggctttctgttgccatggtgatggtgtagccctcccactttgctgtt

SEQ ID NO: 34 - DNA, 60 bp, Homo sapiens
gcaagatgaaggctatcgttgagaagcttcgcttcacatacagaagtgacagctttgaga

SEQ ID NO: 35 - DNA, 60 bp, Homo sapiens
ctgacctttctgagtgacatgggtgtgccaggctagactaggaggttccggtgtctggaa

SEQ ID NO: 36 - DNA, 60 bp, Homo sapiens
gggcgctcgggaaacacaggcatcgccactaccttcatcaacaaagcgtgtgatgagtca

SEQ ID NO: 37 - DNA, 60 bp, Homo sapiens
cagaggagcccttcaccactgtcttagagaatggagcaggcatggtctcttctacttcct

SEQ ID NO: 38 - DNA, 60 bp, Homo sapiens
ccaccgcctgctggaagatggtgaggacttcaatcttggtgatgccctggacagcagtaa

SEQ ID NO: 39 - DNA, 60 bp, Homo sapiens
ttgcttccttcatgtcactttctttttagatattgtacagccagtttctcagaataaaag

SEQ ID NO: 40 - DNA, 60 bp, Homo sapiens
ggaaggtaaagaaacttgctggacaagtcattaacacactttaagcgaatggtgccctgg

SEQ ID NO: 41 - DNA, 60 bp, Homo sapiens
tagccgaaacttgcctggtttttcctactagactgtaagccctctagggacagggacagt

SEQ ID NO: 42 - DNA, 60 bp, Homo sapiens
acaaagccggaagtcctgtataccagctgtatgccctttgcaaccactcaggcagcgtcc

SEQ ID NO: 43 - DNA, 60 bp, Homo sapiens
caggactgcaagaactgatcccctttgtgaagcctgcgcccattgagcaggagccatcaa

SEQ ID NO: 44 - DNA, 60 bp, Homo sapiens
accgggaagactttgacccagcacctgtaaagagcaaatttgattctcttgactttgaca

SEQ ID NO: 45 - DNA, 60 bp, Homo sapiens
agatggttgcaggcaaaatgcactttatagagattttctattgctgggaaggtgtgtttc

SEQ ID NO: 46 - DNA, 60 bp, Homo sapiens
cctgctgagaccttccaaggacagccgtgttggttggactctgaattttgaattgttatt

SEQ ID NO: 47 - DNA, 60 bp, Homo sapiens
tgcaagcagctgaagaatcgctatgagagccgagaccgggaatgggctacctacacctgt

SEQ ID NO: 48 - DNA, 60 bp, Homo sapiens
gctgacgagatggtcatcgaatacgtgggtcagaacatccgtcagatggtggccgacatg

SEQ ID NO: 49 - DNA, 60 bp, Homo sapiens
ctcggagcgtctggccaaatacaaccaactcatgaggatcgaggaggctcttggggacaa

SEQ ID NO: 50 - DNA, 60 bp, Homo sapiens
ttacgggcatgagagtgagttgtcccaagcttcagcagccgcgcggaattctctgtacga

SEQ ID NO: 51 - DNA, 60 bp, Homo sapiens
gtgtggcaaggccttccgccagcggcccacgctcacgcagcatctgcgcacccaccgacg

SEQ ID NO: 52 - DNA, 60 bp, Homo sapiens
cacgagacctttgaccctcgaagacatcgcttctcagaagaggaacttaagccccagcca

SEQ ID NO: 53 - DNA, 60 bp, Homo sapiens
cttttgggtaaaggagagttgagcctgaattaggaatgtgtacattgtaggaatcctggt

SEQ ID NO: 54 - DNA, 60 bp, Homo sapiens
taaagccacccaagtttgtccagtcacgaaatcagcaggaagtgatctataacacccaga

SEQ ID NO: 55 - DNA, 60 bp, Homo sapiens
ttctcaatctaaatgcctttcaggtgggccgcttccttggctacctggttccagggggct

SEQ ID NO: 56 - DNA, 60 bp, Homo sapiens
ttgagtgagatgttggatattgctatcaatcgcagtagtctttcccctgtgtgagctgaa

SEQ ID NO: 57 - DNA, 60 bp, Homo sapiens
ttaattggttttcttgtaaatacagttttgtacaatgttatctctgtgggaggaaggagg

SEQ ID NO: 58 - DNA, 60 bp, Homo sapiens
aagtcctcatagtttaaaatggcctcagcaggcctagtgtatacaaactggttgtatgta

SEQ ID NO: 59 - DNA, 60 bp, Homo sapiens
gggtttcctgacccatcccgcataggtagacctcttgttcctaggcatgacctagggaaa

SEQ ID NO: 60 - DNA, 60 bp, Homo sapiens
taccatcacttgctgcttcatgaagaggcttcgaaaacggtgatcccttactccccaggt

SEQ ID NO: 61 - DNA, 60 bp, Homo sapiens
gggagcttaaaagattttacaagacctaattttgggttccttccttggagccatagttac

SEQ ID NO: 62 - DNA, 60 bp, Homo sapiens
ttcactcccccaagtctttgaaaatttgttcctttcctttgaagtcacattttcttttaa

SEQ ID NO: 63 - DNA, 60 bp, Homo sapiens
ctgccccgttggtgtgattatttcatctgttagatgtggctgttttgcgtagcatcgtgt

SEQ ID NO: 64 - DNA, 60 bp, Homo sapiens
gctactgaaaagaggaatgtgttgaatgtcgcgtttgctgtccactcgtcctagaagttt

SEQ ID NO: 65 - DNA, 60 bp, Homo sapiens
attctctagtgatctgaagcaatgtgactgaagaccagttttaagttatgtgttggcaag

SEQ ID NO: 66 - DNA, 60 bp, Homo sapiens
ctgctacgccaagtatgagagccagacgtcctttgggtccatgtaccccacacgcattga

SEQ ID NO: 67 - DNA, 60 bp, Homo sapiens
tcaagggcgagaagagtggccttatgtccacctgaatgactgcgtgtgtccaaggtggct

SEQ ID NO: 68 - DNA, 60 bp, Homo sapiens
aaattgctcgggagtacaactggaacgtgaagaacaaagctagcaagggctatgaggaaa

SEQ ID NO: 69 - DNA, 60 bp, Homo sapiens
acaacaatgtccaaggatttcgagcagagtcccgatgctggaggtatgacccacggcaca

SEQ ID NO: 70 - DNA, 60 bp, Homo sapiens
gttgatgttcttcagtcctgctccagataactttgaccaggagcctatactggactcttt

SEQ ID NO: 71 - DNA, 60 bp, Homo sapiens
aacacccctggtgtgcctgggacatctgtgaagcctgggcagagaaacgtggttacaaga

SEQ ID NO: 72 - DNA, 60 bp, Homo sapiens
caggacaacttctccaagtttggcctctgtaccttcagtgatgtggctcagctcagccta

SEQ ID NO: 73 - DNA, 60 bp, Homo sapiens
atttgaagaatgcttgaagtcagcgtcttccattccagaaagacccccattcttcctttg

SEQ ID NO: 74 - DNA, 60 bp, Homo sapiens
atcgaggaatgcatcttccgggacgttggaaacacagacatgaagtataagaaccgtgta

SEQ ID NO: 75 - DNA, 60 bp, Homo sapiens
ctttcctgtttgcattggaagccgtggttatctctgttggctccatgggattgattatca

SEQ ID NO: 76 - DNA, 60 bp, Homo sapiens
gatggtgagcggcacagtcccacttccccatctccccaagtaggtggtgttagaaaacct

SEQ ID NO: 77 - DNA, 60 bp, Homo sapiens
acgagatctccatgatcaattccagcatcagctcaagtgctccaatgacagcttttctgt

SEQ ID NO: 78 - DNA, 60 bp, Homo sapiens
gcctttgcctgaccaaagagaagaaccgtatgttccctttactgcacggcctttatcctt

SEQ ID NO: 79 - DNA, 60 bp, Homo sapiens
agagtttgggaccaggacctcctgcttttccatacttaactgtggcctcagcatggggta

SEQ ID NO: 80 - DNA, 60 bp, Homo sapiens
gagggttagtgagcaggttacacttaaaagtacttcagattgtctgacagcaggaactga

SEQ ID NO: 81 - DNA, 60 bp, Homo sapiens
gtgaatgatcagaccctggtagctaagaaggaacttgtccctttgagtcagtgtgcagac

SEQ ID NO: 82 - DNA, 60 bp, Homo sapiens
caaagtaatgtccacttttccctttcatgctgcatattaactggttaattatactgcaga

SEQ ID NO: 83 - DNA, 60 bp, Homo sapiens
ggcaacaaagcaagaccctggtctccaccaaaaataagtaattaattttttaaaaggaga

SEQ ID NO: 84 - DNA, 60 bp, Homo sapiens
cgatacgtcacagccttcaatggggagctcgaggactatatgagtgaccgggttcagttt

SEQ ID NO: 85 - DNA, 60 bp, Homo sapiens
ttgctgataactatggcaggtatacggagaagcgcctttttctgtggccaatgtgtgttt

SEQ ID NO: 86 - DNA, 60 bp, Homo sapiens
gcaccttggtttgacttacacgggacatttgtgtttttggaggaaaagataccctgattc

SEQ ID NO: 87 - DNA, 60 bp, Homo sapiens
caaccacagtccagattttgaccatgacagagattacgaagatgaaccagtaaacgagga

SEQ ID NO: 88 - DNA, 60 bp, Homo sapiens
ccagcccaggggacccgttcctcttgaaccagtcattgcctgtggcaaatgtgtgtatga

SEQ ID NO: 89 - DNA, 60 bp, Homo sapiens
taggaacatgaataccttacaaagctgaaagctggaactttccccaaagggtttgggtat

SEQ ID NO: 90 - DNA, 60 bp, Homo sapiens
tgtctcagtttctaaccactctgtgcaagtaagcatcttacaactggctcttcctcccct

SEQ ID NO: 91 - DNA, 60 bp, Homo sapiens
cagcacagacccagctagttgttgaagccagttcttttttgtcttggtcatgagggaatt

SEQ ID NO: 92 - DNA, 60 bp, Homo sapiens
acctgacacggaagcccatgaccactaaggacctgctgaaaaagttccagaccaagaaga

SEQ ID NO: 93 - DNA, 60 bp, Homo sapiens
tgtgatgaattccttgcaggatcgctacggttcctactgatccgagctctgtgactcagg

SEQ ID NO: 94 - DNA, 60 bp, Homo sapiens
aaatacagacaatagaccaaagtccctgccctcgaggagctttcattctgatggagagaa

SEQ ID NO: 95 - DNA, 60 bp, Homo sapiens
agaagaaagcagctccagcttctactaaacaggctgaccggcgccagtcgatggccttca

SEQ ID NO: 96 - DNA, 60 bp, Homo sapiens
ctatcagaagtggaaacagaaacagaaaattgatgatcgtgactcggacgaagaaggggc

SEQ ID NO: 97 - DNA, 60 bp, Homo sapiens
gtagcaatggatcttgggatagacaaggtaaagccgtatctcccaatgatcatagctcct

SEQ ID NO: 98 - DNA, 60 bp, Homo sapiens
gaccccaagatacagaaggaaatcatgcgtgtgatcggaactcaggtttacacaaactga

SEQ ID NO: 99 - DNA, 60 bp, Homo sapiens
tcaccaacctgccagaggagaccaacgagctcatgctgtccatgcttttcaatcagttcc

SEQ ID NO: 100 - DNA, 60 bp, Homo sapiens
ctcaggggagttctcagcttggacccttatctccccagaatcctggaacctgctccttct

SEQ ID NO: 101 - DNA, 60 bp, Homo sapiens
attcccgtctggtgctctgtaagaccttcaggttggatgaagatggcaaagtcctgaccc

SEQ ID NO: 102 - DNA, 60 bp, Homo sapiens
cgtcacatataggaccaaatcaggcaacatcctgctgcacaagtcgaccattaacaggga

SEQ ID NO: 103 - DNA, 60 bp, Homo sapiens
cattctcagtgataatggaggtttcactgtgaagcatcaccagcagatccttgttttgac

SEQ ID NO: 104 - DNA, 60 bp, Homo sapiens
acatacgagatccagttctctcaggacggtaaggcgtacaccccggtcagcaggaagcca

SEQ ID NO: 105 - DNA, 60 bp, Homo sapiens
tggagggaagagtccagcctctgccgagagcctgctgcgtgcatttttaaaagatgccga

SEQ ID NO: 106 - DNA, 60 bp, Homo sapiens
actttgatgacaacagcgtctcccctgtcaatgagaatcagatcgagtccaaggcagcct

SEQ ID NO: 107 - DNA, 60 bp, Homo sapiens
gaggttgggttcagctccaatgatgatgaggataaagacgatgatgtgatagaggtcact

SEQ ID NO: 108 - DNA, 60 bp, Homo sapiens
ctcctggggattctggggaatgggatgcaacttaagacttctgcctgagaagcctcctcc

SEQ ID NO: 109 - DNA, 60 bp, Homo sapiens
ggccacacgcctcttgacctcacttgcagcaccaaggtgaagaccttgctgctaaatgct

SEQ ID NO: 110 - DNA, 60 bp, Homo sapiens
gtgtccttgagacatttgtgttgtggttccttgtccttgtccctggcgttataactgtcc

SEQ ID NO: 111 - DNA, 60 bp, Homo sapiens
cctttgaggggcacttaagatggagaaatcagttgtggtttcagtgaatcatggtcacct

SEQ ID NO: 112 - DNA, 60 bp, Homo sapiens
gtgtaccaaatagatggaaactactccgggagctctcacgtggtcctggaccatgagacc

SEQ ID NO: 113 - DNA, 60 bp, Homo sapiens
accattcccttcagcaagcctgtaaaagtttatataatgcccaaacctgcacggcgctaa

SEQ ID NO: 114 - DNA, 60 bp, Homo sapiens
tctcacaggatccggagggaaatgtgttagagggtctggaaaattcagtgcttttgagtt

SEQ ID NO: 115 - DNA, 60 bp, Homo sapiens
aggaggtatgaatcccagtccccaggaacctagctctttaaactctggggagtcggattc

SEQ ID NO: 116 - DNA, 60 bp, Homo sapiens
ggcagactcagaattgtccactgtaccttctgtcacaaagacccaagcttcctccagctt

SEQ ID NO: 117 - DNA, 60 bp, Homo sapiens
tgaaagcaaaagcctttgggtttattttgggatagttaggagctagggtagaatataatt

SEQ ID NO: 118 - DNA, 60 bp, Homo sapiens
atggctgttccccaagtgcacacctgaacacttggaggaataaagttctgtttttaattg

SEQ ID NO: 119 - DNA, 60 bp, Homo sapiens
caggactcacgtagcattaaatcagctgtgaatcgtcagggggtgtctgctagcctcaac

SEQ ID NO: 120 - DNA, 60 bp, Homo sapiens
ttcgttaattcttgggcagtggtgagcacgagatgactttctgcagcgtttatcactgtt

SEQ ID NO: 121 - DNA, 60 bp, Homo sapiens
tgcccctccataggtggggtttgtaggggtcttgtggttgcttctggtctctccaaggtt

SEQ ID NO: 122 - DNA, 60 bp, Homo sapiens
caccatcaacaagaatgctcgcgccacgctcagcagcatcagacacatgatccgcaagaa

SEQ ID NO: 123 - DNA, 60 bp, Homo sapiens
tcggctatctggggagcagattttgggtctggatctccctggggagtgggtcctgggctt

SEQ ID NO: 124 - DNA, 60 bp, Homo sapiens
ctattcatctccctgggacttcctgctcatcatagtacccagtgagcccagagatcctac

SEQ ID NO: 125 - DNA, 60 bp, Homo sapiens
cattgtgggttcctgagagtaggacacattgccatggttttgtgggaatcacgcgcccct

SEQ ID NO: 126 - DNA, 60 bp, Homo sapiens
cagaggcacattcctctccatctttccaccgcacacctggaccaggcttgcaggctgcca

SEQ ID NO: 127 - DNA, 60 bp, Homo sapiens
atggttcacctgctgagtcgaggttatgtacttcctgttgtcagttacatccgaaagtgt

SEQ ID NO: 128 - DNA, 60 bp, Homo sapiens
gccccagccaacttcatgggtcactttttctggaaaataatgatctgtacagacaggaca

SEQ ID NO: 129 - DNA, 60 bp, Homo sapiens
attatctctagattggtccttgtgaggggagttttaagaatccagaacatcttgctcttg

SEQ ID NO: 130 - DNA, 60 bp, Homo sapiens
ggtcttcatgctgcaccaagacctgcgatttccacgcatcgccttcttcagttcccgaga

SEQ ID NO: 131 - DNA, 60 bp, Homo sapiens
tcagtcatccaccaggaacgaagatttcctgaagaagacctggtccctctggaggttgcg

SEQ ID NO: 132 - DNA, 60 bp, Homo sapiens
gagggtggtatgatgctggtcagccatgacttcagactcattcagcaggttgcacaggaa

SEQ ID NO: 133 - DNA, 60 bp, Homo sapiens
cagctcctagaacatgagaatcaagcctcttaattttaaactgcggaatgtggcctctgc

SEQ ID NO: 134 - DNA, 60 bp, Homo sapiens
gtccaatgggcgacgagaggaaaagacagagaacccccggttcatgttcaatatcgccga

SEQ ID NO: 135 - DNA, 60 bp, Homo sapiens
gggaaggggctctgggaccagaccccccacactactgcgtctttgtttctatcagtcttt

SEQ ID NO: 136 - DNA, 60 bp, Homo sapiens
tcctagaaaacccattgtgtctctggatctctagcacattactaaaagagcctctgcttt

SEQ ID NO: 137 - DNA, 60 bp, Homo sapiens
aacccttactatccacagattctgtgtttgcaaatgtatctactcgctaaaatatatctg

SEQ ID NO: 138 - DNA, 60 bp, Homo sapiens
gtcccatctggacacttacttgcccacctgccagtgtcttgggcatttccttggcaagga

SEQ ID NO: 139 - DNA, 60 bp, Homo sapiens
ggagtccccgctgtcttcatgaggttggtatttccttttgtggagtgcctcatcacagga

SEQ ID NO: 140 - DNA, 60 bp, Homo sapiens
gcaagaggaaccgagggagagaagaaatcaactttgtggagatcaaaggtgatgaccagc

SEQ ID NO: 141 - DNA, 60 bp, Homo sapiens
agcgccaagctatccctttagcaaaaaagtgtctcagatgtgtaaaagctgaggaatgtg

SEQ ID NO: 142 - DNA, 60 bp, Homo sapiens
tcatgaaagaaagatccttgcactgctggatgctctgagtacggtgcatagtcagaagat

SEQ ID NO: 143 - DNA, 60 bp, Homo sapiens
tctgggcaaggattactctgtggaaggtatgagtgattctctgttgaacttcctgcaaca

SEQ ID NO: 144 - DNA, 60 bp, Homo sapiens
cccactctgattgcatccatttctctgaaagacttgtttgttctgcttctcttcatataa

SEQ ID NO: 145 - DNA, 60 bp, Homo sapiens
gaaaagattgagaaatcggatggttgccgtgtctgtgtagaaagaagtagacatgggaga

SEQ ID NO: 146 - DNA, 60 bp, Homo sapiens
cagagaggaggacagcttctatgtcataaacggtcacaaatggtggatcacaggcatcct

SEQ ID NO: 147 - DNA, 60 bp, Homo sapiens
aaagtgtgaccagtgtggaaacccaaagggcaacagatgtgtgttcagcctgtgccgcgg

SEQ ID NO: 148 - DNA, 60 bp, Homo sapiens
agacaacctgggagacagcctggatcagccacatcaactcagttgtccaccacaggggaa

SEQ ID NO: 149 - DNA, 60 bp, Homo sapiens
tggtgaacagcagtgattctactctttctcttgggccattcattcaccagtccaatgaac

SEQ ID NO: 150 - DNA, 60 bp, Homo sapiens
aagctggggatctgctttatgtgtgagagaactgttctggctgttatgtaaaggagtgca

SEQ ID NO: 151 - DNA, 60 bp, Homo sapiens
gtgatccccaagtctgtgacaccagaacgcattgctgagaactttaaggtctttgacttt

SEQ ID NO: 152 - DNA, 60 bp, Homo sapiens
ccaaagaggcatcgtgatggttctgccttccagtatgagtatgagccaccctgcacgtcc

SEQ ID NO: 153 - DNA, 60 bp, Homo sapiens
ctgtgagggatgtttgggagatgtaagaaatgttcttgcagttaagggttagtttacaat

SEQ ID NO: 154 - DNA, 60 bp, Homo sapiens
cagggttccctcgaacttgggggatctttttaaaagcaaagtaaatcctgccaccatgtt

SEQ ID NO: 155 - DNA, 60 bp, Homo sapiens
tcccatccatcgccttgagactgaccgtaaaccacagacgctctccaggttctcaagagt

SEQ ID NO: 156 - DNA, 60 bp, Homo sapiens
agcctttctcaggggactgtcattgaaaaggaaacgtttgatgtctgtgtcagctgtctt

SEQ ID NO: 157 - DNA, 60 bp, Homo sapiens
acgcagcaccttcttagcgatctaggcctggcaagagctctggccccaaggcctcctctt

SEQ ID NO: 158 - DNA, 60 bp, Homo sapiens
tacaagcgtgacaaagacgagcattaccggacctatgatgcctactccactttctacctg

SEQ ID NO: 159 - DNA, 60 bp, Homo sapiens
tgtagggcccatctagttggggatagaactttataattaccttttggatactgtggttct

SEQ ID NO: 160 - DNA, 60 bp, Homo sapiens
gcttctaaagagacctgctcatacttgctacctccttccagtgggaatttggagactttt

SEQ ID NO: 161 - DNA, 60 bp, Homo sapiens
cgcccatgtgttttggaacatttatgtaagattgtcatatgaaatgtatttgggaactac

SEQ ID NO: 162 - DNA, 60 bp, Homo sapiens
ctgcccctgtcatagggagggggattcccagcgtctgtagtgcttcctgtttgctgaata

SEQ ID NO: 163 - DNA, 60 bp, Homo sapiens
gagattgtgaacggtgccaaaaaacacactcgagatgttgggataactttcccaactcca

SEQ ID NO: 164 - DNA, 60 bp, Homo sapiens
aagagaagaaggatgcagataggaaaagggccataggttttgtggtcggacagactgatt

SEQ ID NO: 165 - DNA, 60 bp, Homo sapiens
aagtgatgcagtggtgtgagatgccctacaccttgttatttgggagactttgagagtcat

SEQ ID NO: 166 - DNA, 60 bp, Homo sapiens
gaggaagtgacctcacagaccagctcagagatgttaccaagaatatcacagcccccaggg

SEQ ID NO: 167 - DNA, 60 bp, Homo sapiens
catcgctgggtcaatagtacttgccgcagtactcttaaaactaggcggctatggtataat

SEQ ID NO: 168 - DNA, 60 bp, Homo sapiens
ctgtgtttccactttatactctttgtccaaaactcagtttcaaaatatttgcaatgggac

SEQ ID NO: 169 - DNA, 60 bp, Homo sapiens
gcccccatgggatcttaccagaggcattactgaagctaaatctttcaactctccccagtc

SEQ ID NO: 170 - DNA, 60 bp, Homo sapiens
taagctgcagagcaggaacatcgtgatgcatctgcctttacccaccaagctcacccccaa

SEQ ID NO: 171 - DNA, 60 bp, Homo sapiens
gatgcccacggctaagcacctgtggctgcattttaacagtaaaggaggccgttgttttca

SEQ ID NO: 172 - DNA, 60 bp, Homo sapiens
aggctgcccaaggcttttctgtcaactcttttgctctctcccgctttgtctaatttagaa

SEQ ID NO: 173 - DNA, 60 bp, Homo sapiens
gcctctgactcccatcatgttgggaaagtcgttgaacctcaccggtgaaacgggcacagt

SEQ ID NO: 174 - DNA, 60 bp, Homo sapiens
cccgttcccgtgcgtgttagtttggacacgaatttagtctaaaaagctgtctggttgtat

SEQ ID NO: 175 - DNA, 60 bp, Homo sapiens
accgcttacacacggttacggagccgatggctgacgtatttcatggcagtcaagtccaat

SEQ ID NO: 176 - DNA, 60 bp, Homo sapiens
tggccccgagcttagggatgtgcttgcaaacccttctcaagggtctcacaaccccaacat

SEQ ID NO: 177 - DNA, 60 bp, Homo sapiens
ctgttgggattaggagtggaatgaggaatagtttaggaccacaagagatttggcctcctt

SEQ ID NO: 178 - DNA, 60 bp, Homo sapiens
tcaactccatcctatcgagattatttaagaatgaagaacataatttttctgctgatgccg

SEQ ID NO: 179 - DNA, 60 bp, Homo sapiens
gtcaacccagcctatccagaatcccgctatacctcggattacttcattagctatggtatt

SEQ ID NO: 180 - DNA, 60 bp, Homo sapiens
ctttctgcttgcaaagcctatagacccttctcagagcggtcctcatggctgggttttctg

SEQ ID NO: 181 - DNA, 60 bp, Homo sapiens
gcaatttaaagacctctttgacctgaacagctctgaagaggacgacactgagggattctc

SEQ ID NO: 182 - DNA, 60 bp, Homo sapiens
tgagtgactgctttgttgaatcagatagtaacaaacatttatttgtagtctggttgtgtc

SEQ ID NO: 183 - DNA, 60 bp, Homo sapiens
agaccttggcagaaatgatccgacaacaccaaaagagtcaactctgtaaatccacagcaa

SEQ ID NO: 184 - DNA, 60 bp, Homo sapiens
agtgggatacttcaaaaggagaacaagtttcccaaaacggtttgccagctgaacagggat

SEQ ID NO: 185 - DNA, 60 bp, Homo sapiens
gctgaccgctctgagctgttctgtttcgtattgctgctctgtgtctgcatgtattgtgac

SEQ ID NO: 186 - DNA, 60 bp, Homo sapiens
cctcatcctcttcagcaactactatgccttcttcaagctgctccgggaccgcttggtatt

SEQ ID NO: 187 - DNA, 60 bp, Homo sapiens
cgtgcgctctctactatgccttgatgttgcctaccttattgtggtatcgtggagttttaa

SEQ ID NO: 188 - DNA, 60 bp, Homo sapiens
agttgacactgttgaataaggcggctgataaaggaagcaggaagcgctatgaaccatcag

SEQ ID NO: 189 - DNA, 60 bp, Homo sapiens
tgaggacaaagtgtgataaaacctctggctcagacttgctctactgaaggcttcttggtt

SEQ ID NO: 190 - DNA, 60 bp, Homo sapiens
ccaggggtgcatactagggtaaagaaaaattttgtaatagcaacagtggtttgggatttt

SEQ ID NO: 191 - DNA, 60 bp, Homo sapiens
aatgcaggatccaaatcctcatcttactttcccgaccttaaggatgtagctgctgcttgt

SEQ ID NO: 192 - DNA, 60 bp, Homo sapiens
agagcagtcttctgagccaccttgtggatcccaaggacctggagccacgggctgccaact

SEQ ID NO: 193 - DNA, 60 bp, Homo sapiens
tagagaccacctatggagagtacccactaacagccatgaccctcactccgggaggcaact

SEQ ID NO: 194 - DNA, 60 bp, Homo sapiens
cctccttccagagcagtgctgatcactggatcctgtatgtgaggaaaggaatcccccagt

SEQ ID NO: 195 - DNA, 60 bp, Homo sapiens
cgtggaactgttttgtatctgcctctttactagtctaccttagtgccatccaccagcttt

SEQ ID NO: 196 - DNA, 60 bp, Homo sapiens
caaaccaacatttccagctctcaggtgtacagaaatgcggtttactttgtaggccacgtt

SEQ ID NO: 197 - DNA, 60 bp, Homo sapiens
caacatccccgagaagatcgagcagacctccaccaagtctctggacggctccgtggacga

SEQ ID NO: 198 - DNA, 60 bp, Homo sapiens
cgtttggctgcactaactttggtagctcagtgtgcatctagagtgggactggggagggag

SEQ ID NO: 199 - DNA, 60 bp, Homo sapiens
tcagttgtatttagctttgagtttctctgcatctgtccaccccatgtgtatataacccag

SEQ ID NO: 200 - DNA, 60 bp, Homo sapiens
ccagaacacagacaagggcaacaaccccaagggctacctgccttcacactatgagagggt

SEQ ID NO: 201 - DNA, 60 bp, Homo sapiens
gaaatagggatggaagtgcatcctctgggaaaaagataatggcttctgattcaacatagc

SEQ ID NO: 202 - DNA, 60 bp, Homo sapiens
cacctcacttgacaaggagatacaaaactatcagttcatagacaccatctgatagggaac

SEQ ID NO: 203 - DNA, 60 bp, Homo sapiens
actcatcaggaaactccgggacgttttacagcagaggctgatcaaattcttcattgacca

SEQ ID NO: 204 - DNA, 60 bp, Homo sapiens
gggggacgcgcacacacaccggtcaccgagacggctggacctgcacgccaccgctgcctt

SEQ ID NO: 205 - DNA, 60 bp, Homo sapiens
gataccagtatttgatgctgggcacgaacgacggcggaaggaacagcttgagcgtctcta

SEQ ID NO: 206 - DNA, 60 bp, Homo sapiens
caacaagtatgaggtagatgacatcgatgaagaaggcaaagagagacacaccctgagccg

SEQ ID NO: 207 - DNA, 60 bp, Homo sapiens
tttcagagtcccgcaggtaccccagctctgcttgccgaaactggaagttatttatttttt

SEQ ID NO: 208 - DNA, 60 bp, Homo sapiens
ctggcatcagtagcatctgtaacagcattaactgtcttaaagagagagagagagaattcc

SEQ ID NO: 209 - DNA, 60 bp, Homo sapiens
aaggagcgcattcgcaaccacaagtaccgcagcctcaacgacctagagaaggacgtcatg

SEQ ID NO: 210 - DNA, 60 bp, Homo sapiens
taaattatgatttactctgtgctgtttccaaattgggaccaggagagaaatatgaacttc

SEQ ID NO: 211 - DNA, 60 bp, Homo sapiens
cctgattcatgattgaagtaccattaccataaatgctatacatccatgcattggatgtta

SEQ ID NO: 212 - DNA, 60 bp, Homo sapiens
ggttgtgactgcttttgggggagcctggggtttgggctcccacctgtttacagacctttt

SEQ ID NO: 213 - DNA, 60 bp, Homo sapiens
caatgacttttctttaccccctagctgtcggcagtactcagtggaagggtgatattatga

SEQ ID NO: 214 - DNA, 60 bp, Homo sapiens
tggtggctgtaattcaggatgacctggacttagcagatagcgggccaggcgggttggaat

SEQ ID NO: 215 - DNA, 60 bp, Homo sapiens
ggcttgtgaggccaatcaaaataatgtttgtgatctctactactgttgattttgccctcg

SEQ ID NO: 216 - DNA, 60 bp, Homo sapiens
cctgacactgatgtgctctacatgactcgaatccagaaggaacgatttggctctacccag

SEQ ID NO: 217 - DNA, 60 bp, Homo sapiens
ctttggggagatctcaaaccatggacgtggagctgtggtttgacagcgctggctctgctt

SEQ ID NO: 218 - DNA, 60 bp, Homo sapiens
catgtctgtcaatctcccttcttgctgattagctttcatatgactatattaaatggaagt

SEQ ID NO: 219 - DNA, 60 bp, Homo sapiens
tctggggaggggtataggtttgaaaggctgtttgaaagaggaatgtttaataaaggcttt

SEQ ID NO: 220 - DNA, 60 bp, Homo sapiens
gtctcctaggttagtgtagcagagattctattctcagataagacttccgtgtcggctgaa

SEQ ID NO: 221 - DNA, 60 bp, Homo sapiens
tgtctgcacacacggacttctgcaaccgcgagaagcctctgagcaccaagtccaagaaga

SEQ ID NO: 222 - DNA, 60 bp, Homo sapiens
tgagatggagaataatgccaatgcaaacattatttctgaggccaagcccgaaggacctag

SEQ ID NO: 223 - DNA, 60 bp, Homo sapiens
taatttgactgtcctcgcagagaatgtgaacatgtgtgtgtgttgtgttaattctttctc

SEQ ID NO: 224 - DNA, 60 bp, Homo sapiens
aacaccagactgttgtctaccagatgatccagcagatccagcagaaacgggagctgcagc

SEQ ID NO: 225 - DNA, 60 bp, Homo sapiens
gtcctgacggtgtgcgtctcccagacccaggccaatgccagggccatccacaggctccgg

SEQ ID NO: 226 - DNA, 60 bp, Homo sapiens
caactccatcaccgtgccctacaaggtgtgggccaagttcggacacaccttctgcaagta

SEQ ID NO: 227 - DNA, 60 bp, Homo sapiens
gattttaaccctcaagggcaatttgatactgagaggttaagggcacagacttctgaatca

SEQ ID NO: 228 - DNA, 60 bp, Homo sapiens
ttttggttctttaaacttctgctgttgggggccatgtgctcaggagctttcttcattcca

SEQ ID NO: 229 - DNA, 60 bp, Homo sapiens
tacctcaaaaatagaacaagagcactccatccatgtgcggatgactgtcaaggtcactga

SEQ ID NO: 230 - DNA, 60 bp, Homo sapiens
tgaagacgatgggcagaggagtgacagccgcagacacacgacagccggcagcaactggaa

SEQ ID NO: 231 - DNA, 60 bp, Homo sapiens
gaaagggcttggactgtgaaaagaaatgtggcccctttccatcttcaagagagatggaat

SEQ ID NO: 232 - DNA, 60 bp, Homo sapiens
cctcacagccgtggagagtaaagtgagcaagctggtgaccgacaaggctgcaggaaagat

SEQ ID NO: 233 - DNA, 60 bp, Homo sapiens
gagagtctccagcaggggaggggaattgtttggactattgttcttcaggattggaataaa

SEQ ID NO: 234 - DNA, 60 bp, Homo sapiens
aatcacaaaaactgtgtgacttacaaggaaagcacgaggcccttgaggaatgatgatgca

SEQ ID NO: 235 - DNA, 60 bp, Homo sapiens
ctcactgcccaggtcgatcaagtggcttttcctgggacctgcccagctttgagaatctct

SEQ ID NO: 236 - DNA, 60 bp, Homo sapiens
tgagtctcccccaaaggtgcagccagaacccgaacccgaacccgggctgcttttggaagt

SEQ ID NO: 237 - DNA, 60 bp, Homo sapiens
gcatgacaagcactcgaaaggctaaatcaaccagaaacatcgaaacaaaagctcaggttg

SEQ ID NO: 238 - DNA, 60 bp, Homo sapiens
ccatcattccgagtcatcatctctgtttgctgccttcctggccagccaggtggaagaaag

SEQ ID NO: 239 - DNA, 60 bp, Homo sapiens
gctgatgcccattctggaccagatggtgatggagcagaacacagagggtgtaaagtggac

SEQ ID NO: 240 - DNA, 60 bp, Homo sapiens
catgtgaagtcacttcctgggtatatgactcggcacaacaatctagacctggtgatcatt

SEQ ID NO: 241 - DNA, 60 bp, Homo sapiens
ctgtggctgcctatgggggactgatgcctgagcgccacctactgcattttggacacctca

SEQ ID NO: 242 - DNA, 60 bp, Homo sapiens
ggttccaatcccagctctgcctttgaagcacttgtggccaccgtcaagtccctttgctct

SEQ ID NO: 243 - DNA, 60 bp, Homo sapiens
catatagaacaggcaaccaagagaacgcggtcagaaggaggtggaactggggagtcctct

SEQ ID NO: 244 - DNA, 60 bp, Homo sapiens
tgctgagtgacatgaaagctgatgtgactcgactcccagctaccattgcccgaattcccc

SEQ ID NO: 245 - DNA, 60 bp, Homo sapiens
gagtcagaggtcatttcaaggtggtggactcaaggatgaagaaggaccaaagagcacagc

SEQ ID NO: 246 - DNA, 60 bp, Homo sapiens
gtcccaaatgccgaagaaattttctgagcctttgtacatagatgaggcaaaaacctgcga

SEQ ID NO: 247 - DNA, 60 bp, Homo sapiens
tgtctcttgctctttcttgggcttctgtacaactcaacttgtatacactgtgtacacaca

SEQ ID NO: 248 - DNA, 60 bp, Homo sapiens
gtcaacttattcctggtacccttcatggacagtgaagcagagagtgaaaacccaccaaga

SEQ ID NO: 249 - DNA, 60 bp, Homo sapiens
cgaaggaccaacaacttcatcatcgctgttaaggaccctcggagcccagatgcagctgga

SEQ ID NO: 250 - DNA, 60 bp, Homo sapiens
tacttttctctctaggatttagattatcatttatgtgctgttgcacagtgaaacctcacc

SEQ ID NO: 251 - DNA, 60 bp, Homo sapiens
ctctgctgagccggcagtgactgaacccggacttggtcctgaccccaaggacaccatcat

SEQ ID NO: 252 - DNA, 60 bp, Homo sapiens
aggccctagctttacgctcatcacctaaacttgtactttatttttctgatagaaatggtt

SEQ ID NO: 253 - DNA, 60 bp, Homo sapiens
ttataacaaagggcctctcttccaaagtaagaaatcacatacgcttacgttttactattc

SEQ ID NO: 254 - DNA, 60 bp, Homo sapiens
tgaaggagcttagcttgtcttcttggcaattcacaatgcctcactccacaccctaaaact

SEQ ID NO: 255 - DNA, 60 bp, Homo sapiens
aaatgaccgggaacggtatgggaaccgtaatgatgatagagataatagtaaccgtgacag

SEQ ID NO: 256 - DNA, 60 bp, Homo sapiens
tgggaaacaaaagcatgtcctttccaactggaaagtcagacagaggcttcaggtacaact

SEQ ID NO: 257 - DNA, 60 bp, Homo sapiens
cctcgcttcagccgggcgattcttcccctcatttgttgcattgtttgcattaatatgaat

SEQ ID NO: 258 - DNA, 60 bp, Homo sapiens
gaaccagggtgaagtcacaggtcccggggtgtggaggctccatcctttctcctttctgcc

SEQ ID NO: 259 - DNA, 60 bp, Homo sapiens
agtggaatcttactgtcatctggacagctgttttcctgtttggatggtaaaggaagttga

SEQ ID NO: 260 - DNA, 60 bp, Homo sapiens
gacgtgccatggtgctttccccaaaagttgtgttgcttttatcagttttctaacttaata

SEQ ID NO: 261 - DNA, 60 bp, Homo sapiens
tgtggcctccaagctccccaggaaagcagtggcagcctctggggtttacaccacaaatat

SEQ ID NO: 262 - DNA, 60 bp, Homo sapiens
aaagaaaatagtttcttgggtatttgtaacgtacaaactatcataaaaattctcctcttt

SEQ ID NO: 263 - DNA, 60 bp, Homo sapiens
ccgatggtggagaatcaaagaggctcggaattctgtctgcatcatcccactccgcagggt

SEQ ID NO: 264 - DNA, 60 bp, Homo sapiens
gcagagaagaaggaatgggttgagaaactgactgaagtttctatcagctctgatgccttc

SEQ ID NO: 265 - DNA, 60 bp, Homo sapiens
ctccgtgagagacgacgggaagtttctggtggaggactattgctttgctgaccttgctcc

SEQ ID NO: 266 - DNA, 60 bp, Homo sapiens
aagatccttaaagatgagatgaacaaagagattgaggcggcacgaaggcagttccagtct

SEQ ID NO: 267 - DNA, 60 bp, Homo sapiens
tggttgttcattagactctcctggagtatttgttaaaatacagattcacattcagtagag

SEQ ID NO: 268 - DNA, 60 bp, Homo sapiens
actgcattacaaggtgattcaagccattcgaaacttcagggccatccacacgctagtttt

SEQ ID NO: 269 - DNA, 60 bp, Homo sapiens
tcctattaccagctcatgaagacagccctcaaggaagatggtgtcctctgctgccagggc

SEQ ID NO: 270 - DNA, 60 bp, Homo sapiens
ggcagccagcgatcattgatggggagctctacaatgaagtgaaggtggaggagagctcgt

SEQ ID NO: 271 - DNA, 60 bp, Homo sapiens
ctgggacactttgggtatattcatgggcattgtttccatctgtcttttctacctgtgcca

SEQ ID NO: 272 - DNA, 60 bp, Homo sapiens
agaaaaatcttcaaggctaaccacttggaagataaaattaacatcatagagaaacggccg

SEQ ID NO: 273 - DNA, 60 bp, Homo sapiens
gtctcagttacaacctattacatatggtccttcacattcagggtctgctacaacagcttc

SEQ ID NO: 274 - DNA, 60 bp, Homo sapiens
cctgcaccgtctcactgtgtgtctcgtgtcagtaatttatatggtgttaaaatgtgtata

SEQ ID NO: 275 - DNA, 60 bp, Homo sapiens
ctggcacggaaaaaggcaaggctgtctttggtcatcaggagtcccagcctgcttcagagt

SEQ ID NO: 276 - DNA, 60 bp, Homo sapiens
tccctacttgttctgtgattgaaccaaggactccagattcacaaactgctactccactat

SEQ ID NO: 277 - DNA, 60 bp, Homo sapiens
cctggagcgcccaacgatgatcaaatatggcatcaacaatatccgggagctggtgggcca

SEQ ID NO: 278 - DNA, 60 bp, Homo sapiens
gccacatactgccgtcttgcccagtttattggaaaccgaagggaactgaatgaggacaag

SEQ ID NO: 279 - DNA, 60 bp, Homo sapiens
ctccgcctgtggctgtgatgaccttgggccagaaggtcaaactccgaagactgaaactct

SEQ ID NO: 280 - DNA, 60 bp, Homo sapiens
tgaatgaactggacacacaggatgaggaggtggcgtcggacagtgatgagtcctctgagg

SEQ ID NO: 281 - DNA, 60 bp, Homo sapiens
cacagccaatgactcagcatcttcacgtcacctacaagaaggtgaccccgtaaacctaga

SEQ ID NO: 282 - DNA, 60 bp, Homo sapiens
ccagcctttggtttcgtttacttgcctacagtgctgtacgcaataagatgatgatcccaa

SEQ ID NO: 283 - DNA, 60 bp, Homo sapiens
agctatacattcttctttctggtcccatcttaaacgtcttctgttgtgctgcaccccaga

SEQ ID NO: 284 - DNA, 60 bp, Homo sapiens
agtttgcccaggatgtgggccgcatgttcaagcaattcaacaagttaactgaggacaagg

SEQ ID NO: 285 - DNA, 60 bp, Homo sapiens
gaatgggatttctgacgagtatcacgtgatccggcacgccatgaacctggaggccgtgaa

SEQ ID NO: 286 - DNA, 60 bp, Homo sapiens
gaggttcctcaggagaatggaatggaagacccatctatctctttctccaaacccaagaaa

SEQ ID NO: 287 - DNA, 60 bp, Homo sapiens
tttgaatgagagtctcatcttggctaggcaccatggcgcaacaactggggaggtggaggt

SEQ ID NO: 288 - DNA, 60 bp, Homo sapiens
aattataccagtgttaagtgacatagataagaactttgcacacttcaaatcagagcagtg

SEQ ID NO: 289 - DNA, 60 bp, Homo sapiens
taccctcttattgttcctcttacgctctgctcaatgaaaccttcctcttgagggtcattt

SEQ ID NO: 290 - DNA, 60 bp, Homo sapiens
ccttctcagtcaaccccttacccttacagtagcaagcatagacccctgtctaacgggggt

SEQ ID NO: 291 - DNA, 60 bp, Homo sapiens
gcgtttcctggccagcaacaagctccagattgtctttgattttgtagcttccaaaggatt

SEQ ID NO: 292 - DNA, 60 bp, Homo sapiens
tgccagctttcagaaggcccagcaagaatttgctgctggtgtcttctccaaccctgcggt

SEQ ID NO: 293 - DNA, 60 bp, Homo sapiens
gcttgcttgaagggacccagagtctttgggcccagatctttaaacctttgtgtcgtgttg

SEQ ID NO: 294 - DNA, 60 bp, Homo sapiens
tcttgttctagaggttttcttgttttcgaatcttgcctgatgaatccagccagaccaagg

SEQ ID NO: 295 - DNA, 60 bp, Homo sapiens
tgccgggcatcgactggctcctggatgacatttccagccgcattttcacagctgactgaa

SEQ ID NO: 296 - DNA, 60 bp, Homo sapiens
gttgctcactgacctgtgaccaggtccaatgtggggagaaatatgaaggaggtagcagcc

SEQ ID NO: 297 - DNA, 60 bp, Homo sapiens
tgaattcagatgagctaatatcttttcctctgaaggagtacttcaagcaatatgaagtag

SEQ ID NO: 298 - DNA, 60 bp, Homo sapiens
ggctggcaagagcagctccaagaagaagaaaaagttccataaagcatcccaggaagatta

SEQ ID NO: 299 - DNA, 60 bp, Homo sapiens
gtttatgagtcgcaccaaacagccacctctgtccctttgccagatgatccggatgatgaa

SEQ ID NO: 300 - DNA, 60 bp, Homo sapiens
ctcctgtgggtgatatttctgggggagataaatccaagaaaggggtaaaacggaagaaga

SEQ ID NO: 301 - DNA, 60 bp, Homo sapiens
tctgataggaatgtgaaagcacggactcttactgctaacttttgtgtatcgtaaccagcc

SEQ ID NO: 302 - DNA, 60 bp, Homo sapiens
agttctacagagactgctcatgttttaacggccacactttttcagacgttacctcttcaa

SEQ ID NO: 303 - DNA, 60 bp, Homo sapiens
gcagttgcagttaggaccacactaaaaggttaatgtccacgctggtgttgaccaagccct

SEQ ID NO: 304 - DNA, 60 bp, Homo sapiens
ccagctgatggatagtgagacggacatggtgcagcagatccgggctctagacagcaacat

SEQ ID NO: 305 - DNA, 60 bp, Homo sapiens
gaattctttgctttctaaactcttccagaaaggactgtgagcaagatgaatttacttttc

SEQ ID NO: 306 - DNA, 60 bp, Homo sapiens
agaatattgctgcaacactatctgtgattggttatctctctatcatgcattgcttcacaa

SEQ ID NO: 307 - DNA, 60 bp, Homo sapiens
gagaggaagaaccgctcttccaagaagagctccaggaaaggcaggacacgaagctcctct

SEQ ID NO: 308 - DNA, 60 bp, Homo sapiens
tcactctcatgttggacacgggcctgccctgttttcgcggccagacaatcaagctcttga

SEQ ID NO: 309 - DNA, 60 bp, Homo sapiens
aacaatgaaaatcttcaggagatatgcaaagcagaaaccctcgtgcaggcccgaaagaga

SEQ ID NO: 310 - DNA, 60 bp, Homo sapiens
actatttaaacctgcctgggagttaggacggatggttttaggaatgaccggaaaactacc

SEQ ID NO: 311 - DNA, 60 bp, Homo sapiens
gtccatcacgcacgatattgaggagaaaggcgtccggatgaagctgacagtgattgacac

SEQ ID NO: 312 - DNA, 60 bp, Homo sapiens
caccacagtgctgccagtgaggacagctgacacccagccagggaaaccattctagtcttt

SEQ ID NO: 313 - DNA, 60 bp, Homo sapiens
ttggactcttcccagggaaattccatcttccagatcaatatgatcaagtacatcaaagac

SEQ ID NO: 314 - DNA, 60 bp, Homo sapiens
cccctgcgtaggcacccagacttggagagacccgtctgctgttaatacttccatcctctt

SEQ ID NO: 315 - DNA, 60 bp, Homo sapiens
aagttgtggtgaagaggttatttatgagttgcaccaaatggccatctctgtctctttcct

SEQ ID NO: 316 - DNA, 60 bp, Homo sapiens
gagcacggtcgtcctgaggataaaagcaaaattgtagcagaaatccgaggcaatgtactt

SEQ ID NO: 317 - DNA, 60 bp, Homo sapiens
tgggttgcagtgccacccttcaaagcctctactagcctcctgtggcttggacagagtctt

SEQ ID NO: 318 - DNA, 60 bp, Homo sapiens
gcccctagtgaaatcatgtgatgtgagacagaaacctaaacatggtacttgattctaaac

SEQ ID NO: 319 - DNA, 60 bp, Homo sapiens
acccacatagcactttgctcttagttacatgtaaaattttagatttctaaaacaggtggg

SEQ ID NO: 320 - DNA, 60 bp, Homo sapiens
agagttcctttgtgattaccattatgggttctgtgatgtgatcccacctaattgtatcca

SEQ ID NO: 321 - DNA, 60 bp, Homo sapiens
gcactttgaacatcctcagcactctctccaatggcaatagttctaagcaaaaaattccag

SEQ ID NO: 322 - DNA, 60 bp, Homo sapiens
gaaattctggaaggtgtcccggccactggagctgtgctatgctcccaccaaggatccaaa

SEQ ID NO: 323 - DNA, 60 bp, Homo sapiens
acgtggaaggactttgaggtccggcatggcaatgaggacaccatcaaggaaatgctgcgt

SEQ ID NO: 324 - DNA, 60 bp, Homo sapiens
ctccccactttgtggccagacaggagttctagaccaggttgtctcctgggacattgacac

SEQ ID NO: 325 - DNA, 60 bp, Homo sapiens
tttccctgagagctcacagtacaatgtttgtttcagaagccccatttgcacaggttttca

SEQ ID NO: 326 - DNA, 60 bp, Homo sapiens
aatcttcaggagatatgcaaagcagaaaccctcgtgcaggcccgaaagagaaagcgaacc

SEQ ID NO: 327 - DNA, 60 bp, Homo sapiens
gacgatgccgactctgatgatgaggacagaggacaggcccaaggtggcagtgacaatgat

SEQ ID NO: 328 - DNA, 60 bp, Homo sapiens
ggaggtctgggatgtctgattatatctgatttctgagctctgggcatggaggtctgtctg

SEQ ID NO: 329 - DNA, 60 bp, Homo sapiens
agacaatcatccacagctattccctccagcatctggttctgtacaaaaattaaatgctta

SEQ ID NO: 330 - DNA, 60 bp, Homo sapiens
ctgtcaccaatgtggacctgccccctaaagagtcaagcatctaagcccaggacatgagtg

SEQ ID NO: 331 - DNA, 60 bp, Homo sapiens
ccctacttgggttcgtctccgcccattttgggttttgtaacagttttgtcttttgggttt

SEQ ID NO: 332 - DNA, 60 bp, Homo sapiens
tccagtatcccccatgtgaaggtcacttcccttctcatggagtcagctgagcatcagctc

SEQ ID NO: 333 - DNA, 60 bp, Homo sapiens
ttgaaaacacagattcccccatctggaattttcaacagcagtcaaggctatcaaaagagc

SEQ ID NO: 334 - DNA, 60 bp, Homo sapiens
tgctcagactcaatgacatggcgtccaccgatgacggcacactacagtcccgactagtga

SEQ ID NO: 335 - DNA, 60 bp, Homo sapiens
ccctttgggaaagcaacacattattgagactcactgtgattcccccgggagtcagactgg

SEQ ID NO: 336 - DNA, 60 bp, Homo sapiens
tttgagaccctgttactgtttgaaaatgcatgcatgttacgatgaatctccaacctgagg

SEQ ID NO: 337 - DNA, 60 bp, Homo sapiens
gcaggagaagactttgaattctaacgacgagccgtgttgaaacttcttttgtatgtgtgt

SEQ ID NO: 338 - DNA, 60 bp, Homo sapiens
cagctcgcgatgccctgcagggctttaagatcacgcagaacaacgccatgaagatctcct

SEQ ID NO: 339 - DNA, 60 bp, Homo sapiens
ttggggacagccttattcccaaatgtctctatccttttgactggagcatcttctgcacaa

SEQ ID NO: 340 - DNA, 60 bp, Homo sapiens
gctgaggatacagctcttctcagtgtctgaacaatctccaaaattgaaatgtatattttt

SEQ ID NO: 341 - DNA, 60 bp, Homo sapiens
gggaggggcactgtctcttttttctctcatttttaaaatgaagtgttgttgcctttgtat

SEQ ID NO: 342 - DNA, 60 bp, Homo sapiens
ctcaggaccattccaagatcatggcagacatccaggcccaatataacgagctgtctcgga

SEQ ID NO: 343 - DNA, 60 bp, Homo sapiens
ctctggtggttgagatcccgccatttcggaatcagaggataaccagccccgttcacgtca

SEQ ID NO: 344 - DNA, 60 bp, Homo sapiens
ggacactgacagctctgacaactctgatttggaagatgacatcatcttatctctgaatga

SEQ ID NO: 345 - DNA, 60 bp, Homo sapiens
gcttccttttatgttttgttttaatcccaaatgtctgaatgttttgcagtgtgtaggggt

SEQ ID NO: 346 - DNA, 60 bp, Homo sapiens
acagtgaagcaggaacagattaacactgagcctctagaagacacagtcctgtccccgacc

SEQ ID NO: 347 - DNA, 60 bp, Homo sapiens
gcgctgtttttaacgtgcccgtttgtactgatgtatgaacttgtcaataaacacaattgt

SEQ ID NO: 348 - DNA, 60 bp, Homo sapiens
tgccattagccggcataccaccataagagaaactcaatcagaaaagaaagtttctccaac

SEQ ID NO: 349 - DNA, 60 bp, Homo sapiens
tcacagacatggaagggaccaccctggggctgactgcttttctgtgctgttggttcccaa

SEQ ID NO: 350 - DNA, 60 bp, Homo sapiens
caataaagaccagtcacttggctgctcttctgaagaaccaagggaagatctttgcctttg

SEQ ID NO: 351 - DNA, 60 bp, Homo sapiens
ctgctgttggggaagcccccaagagatgaggacagttcagaggaggattcagacgagtgt

SEQ ID NO: 352 - DNA, 60 bp, Homo sapiens
atgtttggatgaatctgatgatgagccagagaaggagctcgcccctgagcctgaggagac

SEQ ID NO: 353 - DNA, 60 bp, Homo sapiens
cttgttcaatgtgactactttagttgcctgtccaatatgaagtagaaaagcagatttctg

SEQ ID NO: 354 - DNA, 60 bp, Homo sapiens
agcagatcagggctctagacagcaacatgcaaaccctggtctatgagaactacaataagt

SEQ ID NO: 355 - DNA, 60 bp, Homo sapiens
taaccttggggtcttgggagtagaactttagctttgaataatttaagggcttggcctgta

SEQ ID NO: 356 - DNA, 60 bp, Homo sapiens
agccttcccaagacatggattccttcccagggagacaaagccctgtcaggagcacagcat

SEQ ID NO: 357 - DNA, 60 bp, Homo sapiens
ctggaagaagcttaaccatgtgttcaaagaacggtttcttgcttgcttggtcctggaact

SEQ ID NO: 358 - DNA, 60 bp, Homo sapiens
acatgcctgggtcctggctgatgactgattagtctcttctgtcacaggggtgcctggaga

SEQ ID NO: 359 - DNA, 60 bp, Homo sapiens
ttaaggtgtctggagcccccacacttggccaacctgaccttggaagatgctgctgagtgt

SEQ ID NO: 360 - DNA, 60 bp, Homo sapiens
attgaggaagacggcaccgaaagcgaaggaagctcctgctcctcctaaagccgaagccaa

SEQ ID NO: 361 - DNA, 60 bp, Homo sapiens
agatctgtaccctctgcaagagcaaaggctgctggatcctgcccactgtgtaccatggca

SEQ ID NO: 362 - DNA, 60 bp, Homo sapiens
caccaaactcctggagttccagctggcactcaaggactgtgaggaatgtatccagctgga

SEQ ID NO: 363 - DNA, 60 bp, Homo sapiens
cgtcatcagggactacctggtccaaaaactacagaaacagagccagcagattgcacagga

SEQ ID NO: 364 - DNA, 60 bp, Homo sapiens
cctggagtttgcggtgatcagggtgaagggccagagcttcatgatgcatcagatccggaa

SEQ ID NO: 365 - DNA, 60 bp, Homo sapiens
ttggccaaaatctgaggagcagtctaggttacaggctttttggtaggtaggttctggctg

SEQ ID NO: 366 - DNA, 60 bp, Homo sapiens
ctacgtgcggaccatcatcaacaagaacgctggagccaaactcagcagcatcagatacat

SEQ ID NO: 367 - DNA, 60 bp, Homo sapiens
acctaaattaatgaaccatatttttaaaatcctatttttcccaaacagggccctctgcag

SEQ ID NO: 368 - DNA, 60 bp, Homo sapiens
catgtagaccagatatttgaaagggcagacgatggctagaggtgtaatgtgcagcttgtt

SEQ ID NO: 369 - DNA, 60 bp, Homo sapiens
gcggcttatgttctgaatttgtttatgagaactgatcattagtgagactggccacagtat

SEQ ID NO: 370 - DNA, 60 bp, Homo sapiens
atttaattatcagaagcaagtaatctttccccagataatattttgccctagaagaagccg

SEQ ID NO: 371 - DNA, 60 bp, Homo sapiens
ttctactggaagcaccccaagtcatgagtcttcacgtggacaccctcgtcaccaagtttc

SEQ ID NO: 372 - DNA, 60 bp, Homo sapiens
acttctcgcagtttggcaccgtggaaaaggccgagattattgccgacaagcagtccggca

SEQ ID NO: 373 - DNA, 60 bp, Homo sapiens
aaacctgttggggtagatgtgattaatggggccctcgagtcagtcctgtcctccagcagc

SEQ ID NO: 374 - DNA, 60 bp, Homo sapiens
gaaccagaagatcgagagcctaactttgcaaccattggtctgcaggacatcactttagat

SEQ ID NO: 375 - DNA, 60 bp, Homo sapiens
gcaccccagcattgaaaacaaaatgttaaaatgccaacatttgtgtttaattctagctac

SEQ ID NO: 376 - DNA, 60 bp, Homo sapiens
gagccaagtttgcattttcacacgcatctcacactcctctgcactctcaacttggagagc

SEQ ID NO: 377 - DNA, 60 bp, Homo sapiens
tacgtgttcaagtgatcaaggggtttcatttgctcttgggggattaggtatcatttgggg

SEQ ID NO: 378 - DNA, 60 bp, Homo sapiens
ccataaatcacaggctgagggagaaatggtgagggcacaatagcaaatggaaatacacaa

SEQ ID NO: 379 - DNA, 60 bp, Homo sapiens
tagaccaccagctgaagatctttgacttgcgagggacgtaccagcctctgagcactcgga

SEQ ID NO: 380 - DNA, 60 bp, Homo sapiens
ttctcccagatgcttcaggacaagcccctgcgcacatcgtggcagcggaagatgaaggaa

SEQ ID NO: 381 - DNA, 60 bp, Homo sapiens
gctgagattcattgcagaggttcagaaaagagaccctcgtgactggactgcacagttcat

SEQ ID NO: 382 - DNA, 60 bp, Homo sapiens
agcggtcgctgaaggacatggaggagtccatcaggaacctggagcaagagatttcttttg

SEQ ID NO: 383 - DNA, 60 bp, Homo sapiens
gccagctcctctttgccctcaaggtgctcaacatgatgcccgaggagaagctggttgagg

SEQ ID NO: 384 - DNA, 60 bp, Homo sapiens
gcgccgccatcatggacaccagccgtgtgcagcctatcaagctggccagggtcaccaagg

SEQ ID NO: 385 - DNA, 60 bp, Homo sapiens
caacgtaagtatctcctggctatggtcagcgtattttagccgggccagacccttctcctg

SEQ ID NO: 386 - DNA, 60 bp, Homo sapiens
cggggggcttctcccttcttacaagctcggtcatgcatatatttgatctggcgttgccag

SEQ ID NO: 387 - DNA, 60 bp, Homo sapiens
tgaagtccagtggcaggtgtttgtccccagtgctgagagcagagagaagctcatctcgct

SEQ ID NO: 388 - DNA, 60 bp, Homo sapiens
caggaggttcctcaggagaaaacagaagacccatctatctctttctccaaacccaagaaa

SEQ ID NO: 389 - DNA, 60 bp, Homo sapiens
ttattggtctatcaatttctcccgtctcctgtcccaaagtaataaatcatgtttaataag

SEQ ID NO: 390 - DNA, 60 bp, Homo sapiens
gggctaaagccagacccatttctgaacaggggagtttgtatcatgaatgtttccaggttt

SEQ ID NO: 391 - DNA, 60 bp, Homo sapiens
gctcacagagctgagacatacagtccagtctttggagatcgacctggactccttgagaaa

SEQ ID NO: 392 - DNA, 60 bp, Homo sapiens
agcttgcttgctgatgaacacttccacagtcttttgagctaagtagtttttgtaattact

SEQ ID NO: 393 - DNA, 60 bp, Homo sapiens
ccattatgccttccgcatctttgactttgatgatgacggaaccttgaacagagaagacct

SEQ ID NO: 394 - DNA, 60 bp, Homo sapiens
gatggtcctcaacaacctggtggaaatcattaaccgacccaacacacccaagacactgct

SEQ ID NO: 395 - DNA, 60 bp, Homo sapiens
gtgagtagcaggctacttaagatgcctagtgggtctaaatgtcaaatgctattggcagat

SEQ ID NO: 396 - DNA, 60 bp, Homo sapiens
ccagatacgcaagaacatcacggagactctggtgtccctgagggtccacactgtggatga

SEQ ID NO: 397 - DNA, 60 bp, Homo sapiens
gcatctaggcccaatgccagacctggcaacccatcctaactgtattattaaaaccaagta

SEQ ID NO: 398 - DNA, 60 bp, Homo sapiens
gaaaagagaaatagagctgtatggttgcccccctgattttccagatgaagaagaggaaga

SEQ ID NO: 399 - DNA, 60 bp, Homo sapiens
gatacataacaggcaatacaaatattatcacatagcgtcaatttatttgtgaatattgaa

SEQ ID NO: 400 - DNA, 60 bp, Homo sapiens
aagaattgagttagaactgccctataatgtaatgcagaatatttcccaataatgcctagg

SEQ ID NO: 401 - DNA, 60 bp, Homo sapiens
ctcaagcctttgcgaagctaatgacctgcctctgtgcgaagcttacgggaggctggacct

SEQ ID NO: 402 - DNA, 60 bp, Homo sapiens
cactgggcagcaccaagtccggatgcagatcctcatgatccggtacccgagcagtcagct

SEQ ID NO: 403 - DNA, 60 bp, Homo sapiens
cttgcaccaagacgtccaggccatgtggtatttcggatcagcccagggttcccagtttgt

SEQ ID NO: 404 - DNA, 60 bp, Homo sapiens
gtaagcactcattataatttgttgatgatagtttaagtatatggggtatgcccattagcc

SEQ ID NO: 405 - DNA, 60 bp, Homo sapiens
ttttttctataccccctttcataggacacgctaatgagatgcatatcattaaaagcctga

SEQ ID NO: 406 - DNA, 60 bp, Homo sapiens
ctgagttcctgatgatgttcctgcagttatccttttccttatgatttaaaagtctttagc

SEQ ID NO: 407 - DNA, 60 bp, Homo sapiens
cttttgttatcaggtagactggcatgttcatgggctaagcatagacattactacccaaat

SEQ ID NO: 408 - DNA, 60 bp, Homo sapiens
attgaggtatactgccatctcccagtcatgtgtgaggaccgaaatttgccctatgtctat

SEQ ID NO: 409 - DNA, 60 bp, Homo sapiens
ggaaactgcatgtttcagaaagtttgtctctttttcctactcattatttgaagaagagag

SEQ ID NO: 410 - DNA, 60 bp, Homo sapiens
ttgggatatcactgtgtgtacctgtgcaagtcctggagtgtgttgggtcctcatcagcag

SEQ ID NO: 411 - DNA, 60 bp, Homo sapiens
ggtcatttatgacgagaagaaaggcaccgtctacatctactcctacttccacttcgtgtt

SEQ ID NO: 412 - DNA, 60 bp, Homo sapiens
attgggacttctccccaggatgtactgaattcaaggaagctttctctaggtgtagcagaa

SEQ ID NO: 413 - DNA, 60 bp, Homo sapiens
gaaggccctaccctaaggcatgtttccacaatttctctaaacttttcttttctgatagtc

SEQ ID NO: 414 - DNA, 60 bp, Homo sapiens
taagcatttatgtgtttccataactgacatctgatgcagacctcattctctccccctctt

SEQ ID NO: 415 - DNA, 60 bp, Homo sapiens
ggaactccaagagactcccactgtggactccaaagatcatgatagcagctctggactatg

SEQ ID NO: 416 - DNA, 60 bp, Homo sapiens
ccttttgtagcagtttcccaggttttttcagaagtggtgaatccatgccttggcattcct

SEQ ID NO: 417 - DNA, 60 bp, Homo sapiens
tacctgtgtgagatactagtattgatggtgagacgtcaatagtaaaatatcttggaggta

SEQ ID NO: 418 - DNA, 60 bp, Homo sapiens
aagttccctgatgaagactcctatcagaagtttattcccttcattggcgtggtgaaggtg

SEQ ID NO: 419 - DNA, 60 bp, Homo sapiens
acggctgaacatcatctctaacctggactgtgtgaacgaggtgattggcatccggtcagc

SEQ ID NO: 420 - DNA, 60 bp, Homo sapiens
tctggggctctggagagtgacaacaacacagccctttggctttctaagaagttgatctac

SEQ ID NO: 421 - DNA, 60 bp, Homo sapiens
aatatgactagcttacacaatagctcacatagtacagatactctttacggactccactta

SEQ ID NO: 422 - DNA, 60 bp, Homo sapiens
tttatatggtcggatgctccatgttaggattaaggggtaattaatagtaatgtatgtgga

SEQ ID NO: 423 - DNA, 60 bp, Homo sapiens
actgcatagtcactacttttagtgagtttgaaatctgtttggagagctatgtaagtacca

SEQ ID NO: 424 - DNA, 60 bp, Homo sapiens
agtcaaagaccttgctggtgacaatgtaagttgttaggattctctgaatcggaagttata

SEQ ID NO: 425 - DNA, 60 bp, Homo sapiens
aaatcgggccatccgcaccagaggaagatcattctgccgggacgtggctcggggctatga

SEQ ID NO: 426 - DNA, 60 bp, Homo sapiens
gacactttttggactcaacgttacatttttgaatgtagtaagtaaattaaccaaaaaagt

SEQ ID NO: 427 - DNA, 60 bp, Homo sapiens
tgcgcgttcaagccagtctccaaaaaagccgttcaatagtattattgagcacctgtcagt

SEQ ID NO: 428 - DNA, 60 bp, Homo sapiens
aagatgaacctttggagtttaaaagggttctggacaacatcaaagcagtcttcccgtgtc

SEQ ID NO: 429 - DNA, 60 bp, Homo sapiens
catgtttgtggtcaaggcctatctgcccgtcaacgagtcctttggcttcaccgctgacct

SEQ ID NO: 430 - DNA, 60 bp, Homo sapiens
gacgtcagctgagaaaagcaaggagagtggctcgacccttgacctttctggctccagaga

SEQ ID NO: 431 - DNA, 60 bp, Homo sapiens
gggcaactagtcatctactagttagcttagtaagctaagcattaaatctaagaaatagca

SEQ ID NO: 432 - DNA, 60 bp, Homo sapiens
ttgaccaccattgtctcagagctgcccactttgtgtgtgtcacatgctgcctgagtcaca

SEQ ID NO: 433 - DNA, 60 bp, Homo sapiens
aggcccagagttgcagaccaccttgggctacacagtgacagcctgtctgtacaaaaacta

SEQ ID NO: 434 - DNA, 60 bp, Homo sapiens
ttagtagaccctagattttctctacaaatgtaaaatgttatttttactgttgaaaatcag

SEQ ID NO: 435 - DNA, 60 bp, Homo sapiens
ggaaatggtcttccggtggaccatcaacgacaagcagtccctgaccttccagaaagtggt

SEQ ID NO: 436 - DNA, 60 bp, Homo sapiens
agtcttgggcatccacttcagtagaatttcagctgacaatatgatgaatcattccagaaa

SEQ ID NO: 437 - DNA, 60 bp, Homo sapiens
ggaattggtgacctaggaaaactgttgaattctaaaaagaatgaagttagtttctaaccc

SEQ ID NO: 438 - DNA, 60 bp, Homo sapiens
gcatgagatgaaagatgatattttaattctatcattgaggcatagtctttccaacacacc

SEQ ID NO: 439 - DNA, 60 bp, Homo sapiens
atcaccgttgatgaactcattggtttcacaagtcatttgtgatgtactgtttttgattgg

SEQ ID NO: 440 - DNA, 60 bp, Homo sapiens
gcgctttccccatcaacccaagcctgttcattatgaccccggcaggtgtgttcctggccg

SEQ ID NO: 441 - DNA, 60 bp, Homo sapiens
agcaagtggaaccgacacccaaaatatgacttgaagaatgtaatttaaaatgtagcatag

SEQ ID NO: 442 - DNA, 60 bp, Homo sapiens
aagtgggtttaatttccttttcatgaaaggaaagattagctttcatgcaaacacttggtc

SEQ ID NO: 443 - DNA, 60 bp, Homo sapiens
atgttagttactggcttgccatgtgtaccgacacagctgctttccacagtttaaaaagaa

SEQ ID NO: 444 - DNA, 60 bp, Homo sapiens
cggcgctgcagaggggccctcagtgtggcactcctcgtcaaagaaaaataaaggctagaa

SEQ ID NO: 445 - DNA, 60 bp, Homo sapiens
cgtagtccccactgtagaatttccttaggtggccatattatatactacgtgaactctggc

SEQ ID NO: 446 - DNA, 60 bp, Homo sapiens
ggaggtatcaagcagcaaattccagtttctgggaaatagtggaccagatcgtctccatgg

SEQ ID NO: 447 - DNA, 60 bp, Homo sapiens
agtcagtaatcagcattcaatcaatatgagctctaacatgatgcttgacagttatgcaac

SEQ ID NO: 448 - DNA, 60 bp, Homo sapiens
gggtggcactaatttcctccttaaccagaactttgttccagccactgacccattctaact

SEQ ID NO: 449 - DNA, 60 bp, Homo sapiens
aggttgacctcccatccagcgctgtatctgagtgtagttcattttatatccatagcccaa

SEQ ID NO: 450 - DNA, 60 bp, Homo sapiens
ttcccagttacccctttacccttacagtagcaaaataagacccctatctagtgagggaga

SEQ ID NO: 451 - DNA, 60 bp, Homo sapiens
ggggtgacaagataagccaggctctagagctgctttggatcatgaaccattttcaagttt

SEQ ID NO: 452 - DNA, 60 bp, Homo sapiens
gatgcagtggctctccattgccactctgattcctcctttcttttggtcacagagaaaggg

SEQ ID NO: 453 - DNA, 60 bp, Homo sapiens
acagtctgtgtataccgtggtcagagtgtggctgagacacacatgagatggtaaagaatt

SEQ ID NO: 454 - DNA, 60 bp, Homo sapiens
tgccgaaggacaagccccgatatctgatgggggttggctatgccactgatctggtagtct

SEQ ID NO: 455 - DNA, 60 bp, Homo sapiens
ccagctcctcggaatgtgtttgacttcctcaatgaaaagctgcaaggtcaggctcctggg

SEQ ID NO: 456 - DNA, 60 bp, Homo sapiens
gttgatgttttaaacaggaagctccacggagttcagccctgtgtgcatttcctcatgtat

SEQ ID NO: 457 - DNA, 60 bp, Homo sapiens
gaatacagtgttccttttcatcccatatttgactgaacctaagacacatcaattataagg

SEQ ID NO: 458 - DNA, 60 bp, Homo sapiens
agggaggtcactatgcagggtagcactgggaacaggagacccacctgaggctcagcccta

SEQ ID NO: 459 - DNA, 60 bp, Homo sapiens
aaacattaggtagcagcttgtagaggatatatttagggtcatgatgtccttcttgttggc

SEQ ID NO: 460 - DNA, 60 bp, Homo sapiens
gaatgtaacacactctggggtttgggaggtggatattaatatcattatgcgctttctcac

SEQ ID NO: 461 - DNA, 60 bp, Homo sapiens
aaggactaccctgcactgctttccttggatgagaatgaactcgaagagcagtttgtgaaa

SEQ ID NO: 462 - DNA, 60 bp, Homo sapiens
acacaatgagatgactggactggttcatctgtttattggcaagctcaggacagggtatga

SEQ ID NO: 463 - DNA, 60 bp, Homo sapiens
aaaccctcctgctccaggtggttccccgctggcatttgtagctgggattccgaggccaga

SEQ ID NO: 464 - DNA, 60 bp, Homo sapiens
aaagaaaaagagggttacagatcattgcacatggaaaatattcccagcagtaaccacttc

SEQ ID NO: 465 - DNA, 60 bp, Homo sapiens
agtagggttggtcttgattccccgaagagcctctcatctaaccaggtctttaaaccagac

SEQ ID NO: 466 - DNA, 60 bp, Homo sapiens
cgctctatcccttgctttagccttttgaatgaaagtgagatgtctcatcagctcagatag

SEQ ID NO: 467 - DNA, 60 bp, Homo sapiens
ttgaaaggaaagagtataggggggaagtgccagactaaacgaatcctaagtaaatagggt

SEQ ID NO: 468 - DNA, 60 bp, Homo sapiens
agagagcccttctatgtacatgactgttctgtcccttagctagattagttcatccaactg

SEQ ID NO: 469 - DNA, 60 bp, Homo sapiens
agtagggaaaaaggtttgttccttaattagaggtagtctgggaaatgctagcacttgtgc

SEQ ID NO: 470 - DNA, 60 bp, Homo sapiens
ctgcccaaatggtgagaaataaaaggaagcattctggcctttcaggtttttcaaactcac

SEQ ID NO: 471 - DNA, 60 bp, Homo sapiens
agatttgcccttaatcccagacagtatgagatacaattctgggactttgtcttcgtaacc

SEQ ID NO: 472 - DNA, 60 bp, Homo sapiens
ccgcaattaacactcgaggaagcttaaatttccagctttttgattctcaggaaatgagat

SEQ ID NO: 473 - DNA, 60 bp, Homo sapiens
cctgtgggctgattccagactgagagttgaagttttgtgtgcatcatcatgtgccattaa

SEQ ID NO: 474 - DNA, 60 bp, Homo sapiens
gtagtcagatgtcagagagacttattttcatgtgtaaccttttgaactgttgatgttctt

SEQ ID NO: 475 - DNA, 60 bp, Homo sapiens
gaggacttcattcttggtgatgccttggacagcagcaactccatgcaaaccatccaaaag

SEQ ID NO: 476 - DNA, 60 bp, Homo sapiens
gagtgacctgtgtgagagacagacagatgccccatgaggatggctggacaagaactttta

SEQ ID NO: 477 - DNA, 60 bp, Homo sapiens
tagatccaaacgtcaagtcaatttttgtcacctgtggagactgggacttaaaagtcatgc

SEQ ID NO: 478 - DNA, 60 bp, Homo sapiens
ccttcctgttatatacctgcagttaccatgttcttgttaaggaagaatggcaaatgcaaa

SEQ ID NO: 479 - DNA, 60 bp, Homo sapiens
tcctatgtggactctgatttaagggctataaggcctgtctcttcctacccaatagaggtt

SEQ ID NO: 480 - DNA, 60 bp, Homo sapiens
cagaagaagatagaggagcacatctcaccaaagacaagttgaccctaactcttaaatcat

SEQ ID NO: 481 - DNA, 60 bp, Homo sapiens
aaggtgctttatttgtgggccaaatagtagcaggtattagatacgttggtgggccaagaa

SEQ ID NO: 482 - DNA, 60 bp, Homo sapiens
agatgtggattttcagcaggaactttattccaatgctaatggcagacatcaggaaggagg

SEQ ID NO: 483 - DNA, 60 bp, Homo sapiens
agctgttttctattaacactgaagtactctgagagcttggaaattttcaagtgcaaaatc

SEQ ID NO: 484 - DNA, 60 bp, Homo sapiens
ggccagaagaattgggaggacagtgatgaggaataattttcactctttatcattttatat

SEQ ID NO: 485 - DNA, 60 bp, Homo sapiens
tgtggggacacagagactgacatttcttgccatgggtgatttaattttgggcctcagttt

SEQ ID NO: 486 - DNA, 60 bp, Homo sapiens
gtgtctggattttagccacagtgaaaaacaagggtgaattgcttaatggctgcaatgctg

SEQ ID NO: 487 - DNA, 60 bp, Homo sapiens
aggtaattgggggtatgacttcagtcacttttgaaatattgggaactaaattctctcatt

SEQ ID NO: 488 - DNA, 60 bp, Homo sapiens
aggaagtggaagcatactcttagcccagagctagatgcaaagcagctgtttgaatataac

SEQ ID NO: 489 - DNA, 60 bp, Homo sapiens
cagtgtgagaggaaagaggagttcattgaaagaatcaaacagctggacattgagacccag

SEQ ID NO: 490 - DNA, 60 bp, Homo sapiens
atgatggctctgatgatggaccctcagtgatggatgaaacaagcaatgatgcctttgatt

SEQ ID NO: 491 - DNA, 60 bp, Homo sapiens
ttgaagttggaaatccaaggggaatctaaaaccgaccagatgtttctgctgctggaaagg

SEQ ID NO: 492 - DNA, 60 bp, Homo sapiens
ttataagtgcccttaatatctccagtatctccacagagaattttgtcttcaagccttggc

SEQ ID NO: 493 - DNA, 60 bp, Homo sapiens
atcattgttagtcttggcccaaaaatagttgttatgtatcatgcgtaataactgaccagc

SEQ ID NO: 494 - DNA, 60 bp, Homo sapiens
ggaaggctgtttgctgaataagacaaagatacagacatgcaaagtaaaggatgtgggcct

SEQ ID NO: 495 - DNA, 60 bp, Homo sapiens
ataaatgagagaacattcacatagaacaaaggtgtggtggaggctctcaccagcttaacc

SEQ ID NO: 496 - DNA, 60 bp, Homo sapiens
atttgccaggcccaatgctttaaccttaagctgatatttttgctttagatgtcaatctcg

SEQ ID NO: 497 - DNA, 60 bp, Homo sapiens
atggggctcagggcctctttaccatgtgcagtgaccatttctcagagcaggacttgcaaa

SEQ ID NO: 498 - DNA, 60 bp, Homo sapiens
cctttcacaaagactgtaagccttacccaagcattaattttgctgcataggcggcctgtt

SEQ ID NO: 499 - DNA, 60 bp, Homo sapiens
gccaaccaatcaacaactgtcttcacttgagtgacagtgcttctatagctaacattaacc

SEQ ID NO: 500 - DNA, 60 bp, Homo sapiens
atatgatcttaagagtctaaacattcaagagacgagggcaagaaagccagtcacatgtag

SEQ ID NO: 501 - DNA, 60 bp, Homo sapiens
ggagcagcagttcacatctggaccattcttagcacaggaagccactcattaaagatgtta

SEQ ID NO: 502 - DNA, 60 bp, Homo sapiens
cattgccttttgcctcgtctaataggatccttaggacactgtgggctttaggaatgacta

SEQ ID NO: 503 - DNA, 60 bp, Homo sapiens
caggatcagatgatacaccgggatgtgttttcagtgtgatggaaagattgtttccagtga

SEQ ID NO: 504 - DNA, 60 bp, Homo sapiens
tcatctagaagaacctggaccattcttgacagagctgaatacagtgatcacgttgtcctc

SEQ ID NO: 505 - DNA, 60 bp, Homo sapiens
tttcatgtttgagcattcagattgggctttatttctcaaggcatgtggcaaacctcacaa

SEQ ID NO: 506 - DNA, 60 bp, Homo sapiens
caatgtaaagccagaatatcaacgtccttttgtcaagattttcaaacctatttggctgat

SEQ ID NO: 507 - DNA, 60 bp, Homo sapiens
gttcacaaaaacacctagtaggtattcagttcatattggaatgaatgagaaaatgagcag

SEQ ID NO: 508 - DNA, 60 bp, Homo sapiens
gatttgttccagtgttggagccctttttaatgaaaattctcaacacctacactggaaaaa

SEQ ID NO: 509 - DNA, 60 bp, Homo sapiens
ggcttatctcctttgttttaacagttggggctttggcttccatagcaatgatttgcaaat

SEQ ID NO: 510 - DNA, 60 bp, Homo sapiens
ttcttcctctatatgtttgggaggcattcatgaagaattgagtacacatatatatgggtc

SEQ ID NO: 511 - DNA, 60 bp, Homo sapiens
ggaaagtgaaaaaatagttcctatggtggaaggtgggggtgagacatacctcctctgaaa

SEQ ID NO: 512 - DNA, 60 bp, Homo sapiens
accaggagaatcaggactatcttttgggaaatataagctgggtccttatgatggagtcgg

SEQ ID NO: 513 - DNA, 60 bp, Homo sapiens
cttacattctgcacttcatagttggattctgagcttaggatcatctggagaccccatgga

SEQ ID NO: 514 - DNA, 60 bp, Homo sapiens
gccaaatgctgctcctttttcccagagatagaaagcatcttttaaatcatcctccatttt

SEQ ID NO: 515 - DNA, 60 bp, Homo sapiens
taaaacaaatccttttgattcagccactgtgtattgataatggcttatttattacaatca

SEQ ID NO: 516 - DNA, 60 bp, Homo sapiens
gtccagacctgaacagaagcttcctgacacttagtcagcgccgtctttgacgctaaggac

SEQ ID NO: 517 - DNA, 60 bp, Homo sapiens
ctttgaaaaggatatccttcacattcgttttccagaaaattgaggtcactgacttatttc

SEQ ID NO: 518 - DNA, 60 bp, Homo sapiens
aaccaagatagctaagtaaggtcaggctttgatttgtccttgccagcaaaaagacttagg

SEQ ID NO: 519 - DNA, 60 bp, Homo sapiens
atagtttacatgtgcgacatgagctagtgtttgtacatgtgacagaccttgtttctggat

SEQ ID NO: 520 - DNA, 60 bp, Homo sapiens
tatagcattttctgaagatcatgttgtactcttctttcgtctagatgatttggtcaacag

SEQ ID NO: 521 - DNA, 60 bp, Homo sapiens
catcctgagtggtagaagtccagtgccctttctctacccacagccactcacaccacccag

SEQ ID NO: 522 - DNA, 60 bp, Homo sapiens
gtcctcgtggaactacaacttcatgggtgttcggcatgaccccaacatgaaatatgagct

SEQ ID NO: 523 - DNA, 60 bp, Homo sapiens
catcacacttgatattaggacagcctacctacttgtttgagtgtcacagcctgatatgta

SEQ ID NO: 524 - DNA, 60 bp, Homo sapiens
cctgagtgcctcagggtttggcaatggaatttttaatgtaataaatctttattgagcact

SEQ ID NO: 525 - DNA, 60 bp, Homo sapiens
atgtgagaaaggtttctttaaggtttaatgaccaagttccatgtgagctcttacttggga

SEQ ID NO: 526 - DNA, 60 bp, Homo sapiens
ctctatgcccaacctctttttgcataaatacttatggattcagccaagaggaaaagcact

SEQ ID NO: 527 - DNA, 60 bp, Homo sapiens
agcacgaaagggctttcaatgaattaagtgaaaactttttccttttttacaaaaatgcaa

SEQ ID NO: 528 - DNA, 60 bp, Homo sapiens
gaggaagcatccattgattttcgatttggcaaaacttacctgaagggtatgagagatgcg

SEQ ID NO: 529 - DNA, 60 bp, Homo sapiens
aaagagggttacagatcattgcacatggaaaatattcccagcagtaaacacttccattaa

SEQ ID NO: 530 - DNA, 60 bp, Homo sapiens
gagcctcttacgatctaacttccactaactgggaggaaatgtcttataaataaacaacag

SEQ ID NO: 531 - DNA, 60 bp, Homo sapiens
cacttttatccctatctgtaaaacaaactacaaattgagagagtacattccatagcttgg

SEQ ID NO: 532 - DNA, 60 bp, Homo sapiens
gaaaagaacccagtgctgtaacggaagtctaatagctgctcagtacatagtaaatgctat

SEQ ID NO: 533 - DNA, 60 bp, Homo sapiens
gagtgggttaaagtttatgaagatttttcaactttcttggtggaataccacttaatctgg

SEQ ID NO: 534 - DNA, 60 bp, Homo sapiens
gcatagaggtttaatcaaactcccatatgttgaaattgctcctcatattactggttttac

SEQ ID NO: 535 - DNA, 60 bp, Homo sapiens
cccccaaagtgaattttaaacttgacttatttatgccgttctcatagcaacaggaaaact

SEQ ID NO: 536 - DNA, 60 bp, Homo sapiens
aggcctgattgtggaaatgatgcttagacttgctttcagcaggagtgatgaagccagaat

SEQ ID NO: 537 - DNA, 60 bp, Homo sapiens
ctttgtttgagaagttcctaatgcagtaggagaacaaagtgacagttttcttatttactg

SEQ ID NO: 538 - DNA, 60 bp, Homo sapiens
tctagatagtaataggaaaccaagaatccagcctggtgatggctggagggagtgattgaa

SEQ ID NO: 539 - DNA, 60 bp, Homo sapiens
ccaccagctatttccccagtgtagagtgggcaattctcaccttcaaagagtccccacctg

SEQ ID NO: 540 - DNA, 60 bp, Homo sapiens
gttttgtgtttttggctgtcctgtctattggatgtgatatgttatggatgtgatgtgtta

SEQ ID NO: 541 - DNA, 60 bp, Homo sapiens
gtgctacagaatgaaaatagcattttaggaaggttgagtcagaggtgcgagtggggcata

SEQ ID NO: 542 - DNA, 60 bp, Homo sapiens
caacaccaaccagatggtattcaagacagaggacctgatagcctgggtgtcccagtttgt

SEQ ID NO: 543 - DNA, 60 bp, Homo sapiens
tcgggttcctgcgctgacacctggtctgtgcacctgtgttgctcacagttgaaaactgga

SEQ ID NO: 544 - DNA, 60 bp, Homo sapiens
ttttctcttgggatgtccccgttttgttgtgattgacaactgtattgcattgaagaaagt

SEQ ID NO: 545 - DNA, 60 bp, Homo sapiens
acagtggaacgtgtctgcgaaggcggccaggttctgcagcgaccccagtaccctgtgggt

SEQ ID NO: 546 - DNA, 60 bp, Homo sapiens
tcgtccaggaggtctgggatgtctggttatatctgatttctgacctctgggcatggaggt

SEQ ID NO: 547 - DNA, 60 bp, Homo sapiens
tcaagcctgagaggaagctcaggatctgacatgttcttccttttcctcacaagtcatcat

SEQ ID NO: 548 - DNA, 60 bp, Homo sapiens
atgggaagttactacccaggcttaccaaaaggtcaggtttatataaagtggcgttccttt

SEQ ID NO: 549 - DNA, 60 bp, Homo sapiens
aagccaggaataattttctatctcatgctacctaactcctggaagttatcatgagaccct

SEQ ID NO: 550 - DNA, 60 bp, Homo sapiens
gttagcgcaataatgtcattgaagtctttaactctagcctgactctaaggccagggttca

SEQ ID NO: 551 - DNA, 60 bp, Homo sapiens
ccaggcactcagcgaacacttaaagaatcctgtaatcgcaaagaagatccagaagctgat

SEQ ID NO: 552 - DNA, 60 bp, Homo sapiens
aatatgcacacacaaaactaaagaaaggatgtcacttgagcacacagcttcctgccccct

SEQ ID NO: 553 - DNA, 60 bp, Homo sapiens
agcagaagaacggcttcccgcccaacttcatccactcgctggactcctcacacatgatgc

SEQ ID NO: 554 - DNA, 60 bp, Homo sapiens
aagagtattcccaagatagcaaaggtgtgttgtttttagcaggtgtatttcagctagtta

SEQ ID NO: 555 - DNA, 60 bp, Homo sapiens
aaattggaggcatttctctgaccagtttcctcttcccttaaaaagagcgtcttgcagctg

SEQ ID NO: 556 - DNA, 60 bp, Homo sapiens
acaacagaacaatattggaatggtggtaatacgaggaaatagtatcatcatgttagaagc

SEQ ID NO: 557 - DNA, 60 bp, Homo sapiens
aaagtgacttctgagtacagttaagttcctcctatttgccactgggctgttggttagaag

SEQ ID NO: 558 - DNA, 60 bp, Homo sapiens
cctctttccttggacagtagcaactagtcagaagaccatccaagatagatgcagctgata

SEQ ID NO: 559 - DNA, 60 bp, Homo sapiens
ctttggcttaatgagactgggaccattggtgatgagaaggcaaacatgttcagaagtcaa

SEQ ID NO: 560 - DNA, 60 bp, Homo sapiens
gtaaaccaaaaacttttaaatttcttcaggttttctaacatgcttaccactgggctactg

SEQ ID NO: 561 - DNA, 60 bp, Homo sapiens
tactgctgccatttttattggtgtttgattattggaatggtgccatattgtcactccttc

SEQ ID NO: 562 - DNA, 60 bp, Homo sapiens
gcacaagcccctgaaccatatattgttatcactggatttgaagtcaccgttatcttattt

SEQ ID NO: 563 - DNA, 60 bp, Homo sapiens
ttcagattttcagctgacattagctatagtatacagtaggttaagactcatgtctatgac

SEQ ID NO: 564 - DNA, 60 bp, Homo sapiens
tttaagtttccagctcttcaccgaaatgttgtattcttatttcagtgtttccttccagac

SEQ ID NO: 565 - DNA, 60 bp, Homo sapiens
aggattattccttgctattagtactcattttatgtatgttacccttcagtaagttctccc

SEQ ID NO: 566 - DNA, 60 bp, Homo sapiens
ggctttgttgtaggagcaatgactgttgttatatcatgtatcgagaattctgggcaaaac

SEQ ID NO: 567 - DNA, 60 bp, Homo sapiens
gcaacaatccatctctcaagtagtgtatcacagtagtagcctccaggtttccttaaggga

SEQ ID NO: 568 - DNA, 60 bp, Homo sapiens
gaaatagagattgtctgtagttgattgaaacgagggcagttatgaattgatttgggcaat

SEQ ID NO: 569 - DNA, 60 bp, Homo sapiens
atcagatttctcgttgggctggaaatgtttcgctgttgtatattttaaagtaaattgcac

SEQ ID NO: 570 - DNA, 60 bp, Homo sapiens
ggataacatggctggatgaaagaaatgaccttcattctgagaccaaagtagatttacaga

SEQ ID NO: 571 - DNA, 60 bp, Homo sapiens
ggaagagagattcctatagttcaccgagtcttgaagattcatgaaaaatttgttccttat

SEQ ID NO: 572 - DNA, 60 bp, Homo sapiens
acattggcaaatagcgtgggatagatttgtttcttaatgggtgtgaccaatcctgttttt

SEQ ID NO: 573 - DNA, 60 bp, Homo sapiens
tgagttctacctgatgtaactcttgattggttttaagaactttgttggccttcatttcat

SEQ ID NO: 574 - DNA, 60 bp, Homo sapiens
cacgtccattgctcagctcaaagtggtacagaccaagtatgtggaagccaaggactgtct

SEQ ID NO: 575 - DNA, 60 bp, Homo sapiens
cagctaattggagatgatgtgaaagtagaacgaatcgaatacaaaaaaccttaaagccag

SEQ ID NO: 576 - DNA, 60 bp, Homo sapiens
gcagaaagagatacaatcttgcttgaccgtttgggacatcaatcttccacatgaagtgca

SEQ ID NO: 577 - DNA, 60 bp, Homo sapiens
tggccagtttcagaaaatagttggtggtttaattgagcttgttgatcaacttgcaaaaga

SEQ ID NO: 578 - DNA, 60 bp, Homo sapiens
tcagcatttacgaaatccaggagttttatgttccccttgttgatgttaacgacgactttg

SEQ ID NO: 579 - DNA, 60 bp, Homo sapiens
ctccttgcagaatatcataacgttcatttttgaggtaatagttacaaatgcggtgagcac

SEQ ID NO: 580 - DNA, 60 bp, Homo sapiens
catacaatcttggattcatgcagaacctggcagatttctttcagtgtggctgctttggct

SEQ ID NO: 581 - DNA, 60 bp, Homo sapiens
agctaaatggtattttcatttttctcaagctctccaataaatatgaccaccaagatgcag

SEQ ID NO: 582 - DNA, 60 bp, Homo sapiens
gaatgtcactttgaccctgtcttggaacgtcgtaccaaatgctggaattctacctcttgt

SEQ ID NO: 583 - DNA, 60 bp, Homo sapiens
tcagcatggaaggaattaggaccttttcttcaggattacaggtacactggatgcagccat

SEQ ID NO: 584 - DNA, 60 bp, Homo sapiens
acttcgcccgaattacaaaatgagtgtttttagattcaagtgacggtaaaaggatttgtt

SEQ ID NO: 585 - DNA, 60 bp, Homo sapiens
gtggatgtttttcgaaggataattttggaggcagaaaaaatggacggggcagcttcacaa

SEQ ID NO: 586 - DNA, 60 bp, Homo sapiens
tgcacatccgaatggcctttctgagaaaagtctacagcattctttctctgcaggttctct

SEQ ID NO: 587 - DNA, 60 bp, Homo sapiens
gaaataatagaatgagcacccattccaaagctttattaccagtggcgttgttgcatgttt

SEQ ID NO: 588 - DNA, 60 bp, Homo sapiens
aacctgtatcccaagcagcggtcattcaagacacagatatgcacttatacccataccatt

SEQ ID NO: 589 - DNA, 60 bp, Homo sapiens
cccatgtcaaaaacttggatgaaaatggcttggatttgctctcgaaaatgttaatctatg

SEQ ID NO: 590 - DNA, 60 bp, Homo sapiens
tgaactagaactcagctgggttggtgaattaactaatggaagacatgaaattgttccaaa

SEQ ID NO: 591 - DNA, 60 bp, Homo sapiens
ggatgttatttagacagaaagagtgatgaacggctaactgccttccggaacaagagtatg

SEQ ID NO: 592 - DNA, 60 bp, Homo sapiens
cttttaatctgtgtttctgcaagtgccatccttgtacagtgttaagagggtaacatgggt

SEQ ID NO: 593 - DNA, 60 bp, Homo sapiens
tctttagtgaatatcatctgcatatctctgtaagttcaattgtgtttcttacagtccctg

SEQ ID NO: 594 - DNA, 60 bp, Homo sapiens
atggggattgtgaagaggatgaggaagaggaaaatgatggagaaacacctaaatcttcac

SEQ ID NO: 595 - DNA, 60 bp, Homo sapiens
aacaagtttaaattgtgttgctgatccaattctgtactgttttgtaaccgaaacaggaag

SEQ ID NO: 596 - DNA, 60 bp, Homo sapiens
acgctgctttagaatgaaggtcttccagaagccacatccgcacaattttccacttaacca

SEQ ID NO: 597 - DNA, 60 bp, Homo sapiens
tacaagatcaccacggttttcagccatgctcagacagtggttctttgtgtaggttgttca

SEQ ID NO: 598 - DNA, 60 bp, Homo sapiens
tggggtgaacatgaaattgattacattttgttggatggtgagcagcgtccctctcatgtg

SEQ ID NO: 599 - DNA, 60 bp, Homo sapiens
ggtcccagagatatatagacactggagtactggaaattgaaaaacgaaaatcgtgtgtgt

SEQ ID NO: 600 - DNA, 60 bp, Homo sapiens
ataaaacaggttggcgatcatttcccaagattggtttcccttgagtttttgctaaaacaa

SEQ ID NO: 601 - DNA, 60 bp, Homo sapiens
catggtggttcagaatagatgagcatagcatggttttgtttgtttttgctttcaattttc

SEQ ID NO: 602 - DNA, 60 bp, Homo sapiens
tgtaaccatatttgcatttgaaggtattctcatcaagaaacttctacgacagcaaattgc

SEQ ID NO: 603 - DNA, 60 bp, Homo sapiens
ccatgtttctgaatcttctttgtttcaaatggtgctgcatgttttcaactacaataagtg

SEQ ID NO: 604 - DNA, 60 bp, Homo sapiens
tacaaatctaagcgacagacatctggaggacctgttgatgctagttcagagtatcagcaa

SEQ ID NO: 605 - DNA, 60 bp, Homo sapiens
aaacccgtggaagcctttaaggaatggaaagagtggataataaaatgcctggctgttctc

SEQ ID NO: 606 - DNA, 60 bp, Homo sapiens
gattttggggtctatagagattgctttattggatacttcaagtcattcttgcttgcactt

SEQ ID NO: 607 - DNA, 60 bp, Homo sapiens
taaaaaatgcaggttgtagctttttgatgggctactcatacagttagattttacagcttc

SEQ ID NO: 608 - DNA, 60 bp, Homo sapiens
aagttaggaaagacgatggaggtggaatcctttaagattatgtccagttatttgctttaa

SEQ ID NO: 609 - DNA, 60 bp, Homo sapiens
ggaatgtcttcacttatacttggatttgctctcttcccatttctgattgttgtatagctt

SEQ ID NO: 610 - DNA, 60 bp, Homo sapiens
tccaaatcagatgcatgtgatgatgtatggggtataccgccttagggcatttgggcatat

SEQ ID NO: 611 - DNA, 60 bp, Homo sapiens
atcagtgtattttccataaagtgattcgggcatatttgtgtgaaaacctcagttctgtca

SEQ ID NO: 612 - DNA, 60 bp, Homo sapiens
catgtgatcacctatcgggattcaatgtttgtaacagataccttgtggttttgtactata

SEQ ID NO: 613 - DNA, 60 bp, Homo sapiens
agcatgttgttgttgaagtgtggagttgtaactctgcgtggactatggacagcacacaat

SEQ ID NO: 614 - DNA, 60 bp, Homo sapiens
gggcagtatcagatagcagttgaaaatcaccttgtgctgctccatccactgtggattata

SEQ ID NO: 615 - DNA, 60 bp, Homo sapiens
atgctgaatcttccctttgccttttcaggatttaggcctgtaagaaactatgcctgattc

SEQ ID NO: 616 - DNA, 60 bp, Homo sapiens
aactggctactgagtcatgatccttgctgataaatataaccatcaataaagaagcattct

SEQ ID NO: 617 - DNA, 60 bp, Homo sapiens
tgggagatggagaccattagccaatcacaggagacccaaatctgcttgttatctacagaa

SEQ ID NO: 618 - DNA, 60 bp, Homo sapiens
ccaaccgactaattcatcaaaccaacttaatacttcagaccttcaaaactgtggcctgaa

SEQ ID NO: 619 - DNA, 60 bp, Homo sapiens
tggttgaagtcagcctacactacagtgcacagttgaggagccagagacttcttaaatcat

SEQ ID NO: 620 - DNA, 60 bp, Homo sapiens
ctcatgagtgcaactgtggcttagctaatattgcaatgtggcttgaatgtaggtagcatc

SEQ ID NO: 621 - DNA, 60 bp, Homo sapiens
catggatgaggctagaccctaagaagtaattaagtcaatgtaaatcaaatggaagttttc

SEQ ID NO: 622 - DNA, 60 bp, Homo sapiens
tgcagagtttctctatcgcattggtcaaccaaaagagacgcattccattgggcgagatta

SEQ ID NO: 623 - DNA, 60 bp, Homo sapiens
ctgttcctgtgatgtggaggaaattttccgcaaggttcgattttcatttgagcagccaga

SEQ ID NO: 624 - DNA, 60 bp, Homo sapiens
tgagtgaaagtgacatcctggccacctcacgcatttgatcacagactgtagagttttgaa

SEQ ID NO: 625 - DNA, 60 bp, Homo sapiens
tgtgacttccctgactactaccttcatatttcatttcaaattcaaacttctgaggttgca

SEQ ID NO: 626 - DNA, 60 bp, Homo sapiens
tgataaaagaagtaaggctttgaaagcttcagcgcctgctcctggtcatcactaaccaga

SEQ ID NO: 627 - DNA, 60 bp, Homo sapiens
gggcaatatttgcccattctggtgtaacttatgtgactctagtgcttaacagctgccgtt

SEQ ID NO: 628 - DNA, 60 bp, Homo sapiens
attatcaactcactggtaacaacagtattcatgctcatcgtatctgtgttggcactgata

SEQ ID NO: 629 - DNA, 60 bp, Homo sapiens
acagcatcaatagaaagtcatctttgagataatttaaccctgcctctcagagggttttct

SEQ ID NO: 630 - DNA, 60 bp, Homo sapiens
aggtccttccactttttggagagtagccaatctagcttttttgtacagacttagaaatta

SEQ ID NO: 631 - DNA, 60 bp, Homo sapiens
ctccaagaaaagttgtctttctttcgttgatctctgggctggggactgaattcctgatgt

SEQ ID NO: 632 - DNA, 60 bp, Homo sapiens
ggatcagtatgccgtaggatttacagaatattttcacatgcttattttcatcatcggcag

SEQ ID NO: 633 - DNA, 60 bp, Homo sapiens
gccaccctagagggaaaaaatagaacactttacttacagtcggtaacctctattgaagaa

SEQ ID NO: 634 - DNA, 60 bp, Homo sapiens
aagacatcagtcaggatcatgtgaagaaaacagtgaccattgaaaatcaccctcatctgc

SEQ ID NO: 635 - DNA, 60 bp, Homo sapiens
atggaggtgattggttctctttacacattaacactgtaccaagctttgcagatcttttcc

SEQ ID NO: 636 - DNA, 60 bp, Homo sapiens
tgtatatagccagtgttaaatccttaaatgcaatacagcctctgattattgagcttcctc

SEQ ID NO: 637 - DNA, 60 bp, Homo sapiens
gacctgttgactctgcagggggcatccatttagcttcaggttgtcttgtttctgtatata

SEQ ID NO: 638 - DNA, 60 bp, Homo sapiens
caaaccgaatacggtcagcagtcaactccagggtttgggcttgattcctgttgaataata

SEQ ID NO: 639 - DNA, 60 bp, Homo sapiens
caggattgttggtcatttgactcatgccttgaagcaaggagaatacggtcttgccagtat

SEQ ID NO: 640 - DNA, 60 bp, Homo sapiens
gcaagatagtgtttcagtgctggcatattttggaattctgcacattcatggagtgcaata

SEQ ID NO: 641 - DNA, 60 bp, Homo sapiens
ctttgacaaacatctcccagcaaaagtgccggttagtcaggtttgttgaaaatacagtag

SEQ ID NO: 642 - DNA, 60 bp, Homo sapiens
atttacttgcatatgtaaaccattgctgtgccattcaatgtttgatgcataattggacct

SEQ ID NO: 643 - DNA, 60 bp, Homo sapiens
acacgtttgcatagactacacacatgtcatgcgtttatggcaggtagctggtatttattc

SEQ ID NO: 644 - DNA, 60 bp, Homo sapiens
atatgtctatatatatgaggaacttgtgttttttaaatggtggccaggtagaggaactag

SEQ ID NO: 645 - DNA, 60 bp, Homo sapiens
ggcaaggagcagaagacatagacgttgaaacagaaacagaaggatgaaggacagtttttt

SEQ ID NO: 646 - DNA, 60 bp, Homo sapiens
ctgagtgcaaaactcagtagactcctctttgtcacttctctggagatccagcattcctta

SEQ ID NO: 647 - DNA, 60 bp, Homo sapiens
tgaagctcaggcattgttggaaaagaatttatcgactgccacaaagaatcttgattccct

SEQ ID NO: 648 - DNA, 60 bp, Homo sapiens
gccttttaaagttttgctgaagaatgtgtctgtggttaggatagcacaagcattaacttt

SEQ ID NO: 649 - DNA, 60 bp, Homo sapiens
ccgtggcatgtaatggacattgcaagttccccttttcatccagagcctttttgagtttca

SEQ ID NO: 650 - DNA, 60 bp, Homo sapiens
tagcagagagagactaaacattgtcgttagtttaccagatccgtgatgccacttacctgt

SEQ ID NO: 651 - DNA, 60 bp, Homo sapiens
ggaaggtgtggcaatgtgtccaggctgctctctcattataaaagtgatttatgacaaaga

SEQ ID NO: 652 - DNA, 60 bp, Homo sapiens
aacgttacatgactcgttgagaaagttgaggaatttcctctaccacctttgttgcttgaa

SEQ ID NO: 653 - DNA, 60 bp, Homo sapiens
ttgcgcagtttaagattatttcaaaaattagaggagaatggtgacttataccttgctgtc

SEQ ID NO: 654 - DNA, 60 bp, Homo sapiens
tctgtattgctgtttccaactgttgttttgaccctatagtttactactttacatcggaca

SEQ ID NO: 655 - DNA, 60 bp, Homo sapiens
gggacttctatgatagacggacaactaagcctgagtttttgagacctggtcctcgaaaaa

SEQ ID NO: 656 - DNA, 60 bp, Homo sapiens
ctctggttgctatatctcatcaggaaattcagataatggcaaagaggatctggagtctga

SEQ ID NO: 657 - DNA, 60 bp, Homo sapiens
agatttgtttaagtcccctacactttcttatttctaaatgatcaagagtacacttcctgg

SEQ ID NO: 658 - DNA, 60 bp, Homo sapiens
acgtctcaaagaaatccaaacatgaggaggaagaatggactgatgacgacctggtagaat

SEQ ID NO: 659 - DNA, 60 bp, Homo sapiens
gatccagcactgatgaggccagggagattggatagaaaaattgaatttagcttgcccgat

SEQ ID NO: 660 - DNA, 60 bp, Homo sapiens
agtcctagactgaagtcagtaggaattccagtattgtgtctaaattctgtggatgatgtt

SEQ ID NO: 661 - DNA, 60 bp, Homo sapiens
ctacaagattggcaaagagatgcagaatgcataagatgaacattgcatgaccggatcatt

SEQ ID NO: 662 - DNA, 60 bp, Homo sapiens
actgaaaatgtgctggggtttgttctgctgtcactgtttatgctgctggaacttagcact

SEQ ID NO: 663 - DNA, 60 bp, Homo sapiens
gcgttggaagagttgttgggggttttttgcatccatagcactggttactttgaacaaata

SEQ ID NO: 664 - DNA, 60 bp, Homo sapiens
tctgtgtagaagaaccttttgatggaacaaatacagccagagcagtgcacgaaaagcaga

SEQ ID NO: 665 - DNA, 60 bp, Homo sapiens
tggtgcttgctctttcacttaactgataagagggacatgcctactaggagtttttaatga

SEQ ID NO: 666 - DNA, 60 bp, Homo sapiens
aagccataagaagacttcctgagaacctttataatgacaggatgtttcgcattaagaggg

SEQ ID NO: 667 - DNA, 60 bp, Homo sapiens
tttgtggatttagtccctgggattcagtctgtagaaatgtctaatagttctctatagtcc

SEQ ID NO: 668 - DNA, 60 bp, Homo sapiens
aatattaatgtctagttgttctatattataaccacatttgcgctctatgcaagcccttgg

SEQ ID NO: 669 - DNA, 60 bp, Homo sapiens
taaactttgtttagccacttaaaatctgcttatggcacaatttgcctcaaaatccattcc

SEQ ID NO: 670 - DNA, 60 bp, Homo sapiens
tttcttgaacatggtatcttcacatcttggaccttggtcagttgtgctattcattattaa

SEQ ID NO: 671 - DNA, 60 bp, Homo sapiens
acatgtcataagtggtacccacttcccctttttactgtagggtggataactcttaggatt

SEQ ID NO: 672 - DNA, 60 bp, Homo sapiens
aacatgaacagctggaagagagttttcaggaactagtggaagattaccggcgtgttattg

SEQ ID NO: 673 - DNA, 60 bp, Homo sapiens
ggcccaatgtaaatctaacctccaatcatcttttatatcattactggattgctgtaagcc

SEQ ID NO: 674 - DNA, 60 bp, Homo sapiens
cctatgaggattatgtcgaaggacttcgggtgtttgacaaggaaggaaatggcaccgtca

SEQ ID NO: 675 - DNA, 60 bp, Homo sapiens
gcctggaaagctacagcaatgggaaagaactatgtgaatgggaagactttccttgagaaa

SEQ ID NO: 676 - DNA, 60 bp, Homo sapiens
tatggtcgcactaatggaagacaaatggcaaatcttgaaatagaattggggcaattacct

SEQ ID NO: 677 - DNA, 60 bp, Homo sapiens
tgttacaatcagacagtcctatagactgatctatcctcgagccccagatctgtttcctac

SEQ ID NO: 678 - DNA, 60 bp, Homo sapiens
aaactggattgttgggtatattttggaagtgtgccagaattggtgaacggaagagtcctt

SEQ ID NO: 679 - DNA, 60 bp, Homo sapiens
aactcaagaactctttattttctatcattctttctagacacacacacatcagactggcaa

SEQ ID NO: 680 - DNA, 60 bp, Homo sapiens
tcactggaggaagattttcccttgcttctgcataaaattttaactccataacttataagc

SEQ ID NO: 681 - DNA, 60 bp, Homo sapiens
atcaattgggtggggagaagaattttcattgtccaagcaccctcagggaacagaagtcaa

SEQ ID NO: 682 - DNA, 60 bp, Homo sapiens
actgtcttcttggcactttcaggatttcttaatgctgatatatggactcttagaatggaa

SEQ ID NO: 683 - DNA, 60 bp, Homo sapiens
ttgtctttcagcaaggactggtctttctatctcttgtactacactgaattcacccccact

SEQ ID NO: 684 - DNA, 60 bp, Homo sapiens
agcctttccctatttcagcacaatcttagactcatatttgcacacttttgtgtcgtgaag

SEQ ID NO: 685 - DNA, 60 bp, Homo sapiens
ccatgtactattttacctatgacccgtggattggcaagttattgtatcttgaggacttct

SEQ ID NO: 686 - DNA, 60 bp, Homo sapiens
ctggtggaaatgttgttctctgaagattaagattttaggatggcaatcatgtcttgatgt

SEQ ID NO: 687 - DNA, 60 bp, Homo sapiens
tatgtttgagagggtaaaaatgtatgagcagcttaactgaagtagaactattcatgatgc

SEQ ID NO: 688 - DNA, 60 bp, Homo sapiens
aaactgtggaacaacttcaggccaaaaacagagaactactcaaacaggtcgcagcattat

SEQ ID NO: 689 - DNA, 60 bp, Homo sapiens
aaacaaatgagacttatggaaaattggaagctgtgcagtataaaactcaagttgttgctg

SEQ ID NO: 690 - DNA, 60 bp, Homo sapiens
gtttttgatggccttttaaacaagactccagtatgtgaaggttaattgctgtgctccaca

SEQ ID NO: 691 - DNA, 60 bp, Homo sapiens
ccccatctcaagcaagaatggcgttggtttcttccatttcaaactaatcagcattctcca

SEQ ID NO: 692 - DNA, 60 bp, Homo sapiens
tgtcttttcaaagtgctgccagttgaaaagggaagcattatgtttacaaatctgttttga

SEQ ID NO: 693 - DNA, 60 bp, Homo sapiens
gggctttgggactgaagttactgaaaaggaggtagaaatactcttcattcaagtcaatca

SEQ ID NO: 694 - DNA, 60 bp, Homo sapiens
cattgttcgcatgattgagtccaggcaaaagcggaagaaaaaggcctattgccctcaaat

SEQ ID NO: 695 - DNA, 60 bp, Homo sapiens
aaagcattgtgtttttaagattgtgtcgatattcacctaaaaacttgtgccaaaagcacc

SEQ ID NO: 696 - DNA, 60 bp, Homo sapiens
tcctttggagtaaaactagtgcttaccagtttccaattgtatttagcttctggttggaat

SEQ ID NO: 697 - DNA, 60 bp, Homo sapiens
gcttggtcacctgaattgttttcataaaaagtcacctgaacccaattcctgaacttttaa

SEQ ID NO: 698 - DNA, 60 bp, Homo sapiens
gccacatttttagaacactgtttaacatttttgcaaaaccttcttgtaggaaaagagagc

SEQ ID NO: 699 - DNA, 60 bp, Homo sapiens
aaatacatttgaagtcatccctgagaatacggtgatctatggtgcagactgccttcgtcg

SEQ ID NO: 700 - DNA, 60 bp, Homo sapiens
tataatctcagcttgtattagtttttgaatgctcccatcgaggaagtgtaacaatccatg

SEQ ID NO: 701 - DNA, 60 bp, Homo sapiens
aaagccatgaagaaagccacaaagagtagctgagttactgggcccagaggctgggcccct

SEQ ID NO: 702 - DNA, 60 bp, Homo sapiens
aaagagcagagcgctttgggattgcctgatgaaaagttcctgatactttctgttctccag

SEQ ID NO: 703 - DNA, 60 bp, Homo sapiens
tctactctgagtggggctaaataagttattttctctgaccgcctactggaaatattttta

SEQ ID NO: 704 - DNA, 60 bp, Homo sapiens
aagtcagaagagctcatatatataattctaatgtcccacctatgtccattccatgtacca

SEQ ID NO: 705 - DNA, 60 bp, Homo sapiens
taactcccattgacattgcttcttaccagacatggggaaaagctacctttcctgaaaggg

SEQ ID NO: 706 - DNA, 60 bp, Homo sapiens
aaagtgggaaataacttgcaacgtctgttagagatggttgctacacatgttgggtctgta

SEQ ID NO: 707 - DNA, 60 bp, Homo sapiens
ccgcaatgaagcttggagatacatgggtggctttgcaaagagtgtttccttttctgatgt

SEQ ID NO: 708 - DNA, 60 bp, Homo sapiens
aatcctaaagcataagttagtcttttcctgattcttaaaggtcatacttgaaatcctgcc

SEQ ID NO: 709 - DNA, 60 bp, Homo sapiens
gaatggggacattgataccccctttgaagtgagccagtttttacgtcaggtttatgatgg

SEQ ID NO: 710 - DNA, 60 bp, Homo sapiens
tacctggatcagacagttgtgcctatcttattacagggacttgctgtgcttgcaaaggaa

SEQ ID NO: 711 - DNA, 60 bp, Homo sapiens
taatactaactatttagtatactgtcagtactgtacatctgcacactggtgttaataggg

SEQ ID NO: 712 - DNA, 60 bp, Homo sapiens
catggatatttttatgtacagaagtatgtctcttaaccagttcacttattgtactctggc

SEQ ID NO: 713 - DNA, 60 bp, Homo sapiens
cagattgggaaaatgaggtacgttagtgttcgcgattttaaaggcaaagtgctaattgat

SEQ ID NO: 714 - DNA, 60 bp, Homo sapiens
ggacaaaaggtgggtgaattttctggagccaataaggaaaagcttgaagccaccattaat

SEQ ID NO: 715 - DNA, 60 bp, Homo sapiens
agagagctgaaaccagctcgaatatatggattgggatctttagctctgtatgaaaaagct

SEQ ID NO: 716 - DNA, 60 bp, Homo sapiens
atgtctatccacaggctaaccccactctatgaatcaatagaagaagctatgaccttttgc

SEQ ID NO: 717 - DNA, 60 bp, Homo sapiens
aaagtcagcatgttttaactttgttgttttactatcctcaggcatccattccaatcaaga

SEQ ID NO: 718 - DNA, 60 bp, Homo sapiens
agccaagacttaacaagcactgactaccgttcccttgagctaccattatcacaagggttt

SEQ ID NO: 719 - DNA, 60 bp, Homo sapiens
tgctgttctgtaagagtgtggattctttctatcaactgctgatatcatcttcaggaagca

SEQ ID NO: 720 - DNA, 60 bp, Homo sapiens
ctgataaaacttacagccccctacaccaagagtgtatctgtgaaagagctcctacacttt

SEQ ID NO: 721 - DNA, 60 bp, Homo sapiens
gatcacaagtgcagcattccttaattccttctgctatatgtcacacagttgttatttgga

SEQ ID NO: 722 - DNA, 60 bp, Homo sapiens
atcttctgcctcaactgtaaaccacatgtaagtgcttaatggagactgttttcattcttg

SEQ ID NO: 723 - DNA, 60 bp, Homo sapiens
agccaaagaagatggagactcttaggcaagaatgtttttcaccattattctctcacaatg

SEQ ID NO: 724 - DNA, 60 bp, Homo sapiens
gattctgtatcttttggaaaaaagccgagagttgaagatagtatatttctggtagtactg

SEQ ID NO: 725 - DNA, 60 bp, Homo sapiens
agaaacgaccacaagtgtatttttagtcatctacacgtcaaatatcccaagacagattat

SEQ ID NO: 726 - DNA, 60 bp, Homo sapiens
aaatcgaacaggacaatgggtagatggagctacatttaccaaatcgtttggcatgacagg

SEQ ID NO: 727 - DNA, 60 bp, Homo sapiens
tacacatgaatgaatccaatcttataaccttgaagtgctgtaccagtgctggctgcaggt

SEQ ID NO: 728 - DNA, 60 bp, Homo sapiens
atgttcagactggttcttcttacatatactatgtttcgtctacagttgcctatgctattg

SEQ ID NO: 729 - DNA, 60 bp, Homo sapiens
tatagaatatagtccagttaaatctttggtttcagtatgtctgaagagtacagtgagagg

SEQ ID NO: 730 - DNA, 60 bp, Homo sapiens
gctgaatcagacacttggaaaagaacaaaacagctcacaggacccaacctagtgatgcaa

SEQ ID NO: 731 - DNA, 60 bp, Homo sapiens
tgctcaccatacggctctaacagattaggggctaaaacgattactgactttccttgagta

SEQ ID NO: 732 - DNA, 60 bp, Homo sapiens
atggggtttatgccagttacatacaaggatcctgcatatctcaaggaccctaaagtttgt

SEQ ID NO: 733 - DNA, 60 bp, Homo sapiens
aggaaagaaaaagaagtaacctagtatcagcatcaagtatgtggtactactgtaagagac

SEQ ID NO: 734 - DNA, 60 bp, Homo sapiens
agctctctatggaccagtaatctgataaataaccgagctcttctttggggatcaatattt

SEQ ID NO: 735 - DNA, 60 bp, Homo sapiens
ttacaagtgtacccaataactgaaaatgttttaactcactctcatttgtaagcagtccac

SEQ ID NO: 736 - DNA, 60 bp, Homo sapiens
cattccttgctcagcatgccagcctttaagattgaattagattgtgttgttgtggtttta

SEQ ID NO: 737 - DNA, 60 bp, Homo sapiens
aaacaactcaagcattctggtggcaacatagagattgtaggctgcttctaagaaagttat

SEQ ID NO: 738 - DNA, 60 bp, Homo sapiens
catcctttttgtggtgatcaccagtcaagaggaagtccaagagaaatatgtggtgtgtgt

SEQ ID NO: 739 - DNA, 60 bp, Homo sapiens
cattgctcttttattttttccattaagagactcattgcttgggaaatgctttcttcgtac

SEQ ID NO: 740 - DNA, 60 bp, Homo sapiens
aaatacgcacattgtccaatccagtgattttaatcatacagtttgactggggcaacttta

SEQ ID NO: 741 - DNA, 60 bp, Homo sapiens
aacacaactagagtgcaattttggcatcttaggagggaaaaaggacagtttacaactgtg

SEQ ID NO: 742 - DNA, 60 bp, Homo sapiens
aggacttgggtcaacatggattagaagaggattttatgttataaaagaggattttcccac

SEQ ID NO: 743 - DNA, 60 bp, Homo sapiens
taatctgacatcaccccagcgccatttgtaaagagcaactttccagcagtacatttgaag

SEQ ID NO: 744 - DNA, 60 bp, Homo sapiens
tgaagctatttctgggagcccagaagaaatgctcttttgcttggagtttgtcatcctaca

SEQ ID NO: 745 - DNA, 60 bp, Homo sapiens
aagacatggatcatggtgtgctggtggttggctacggatttgaaagcacagaatcagata

SEQ ID NO: 746 - DNA, 60 bp, Homo sapiens
tctgttgatgaccttggatgctgtaaagtgattcgtcatagtctctggggtacccatgta

SEQ ID NO: 747 - DNA, 60 bp, Homo sapiens
ttgagggatacctaatttgcattcggttaggggatatttttcaacctcttgctttatact

SEQ ID NO: 748 - DNA, 60 bp, Homo sapiens
ttgttactaagcagatttaagggtcagtgggggaaggctatcaacccattgtcagatcag

SEQ ID NO: 749 - DNA, 60 bp, Homo sapiens
gcttcagtggaggaagtaatggtgagcctgcaaaacttgacatcacttaccagcagcatc

SEQ ID NO: 750 - DNA, 60 bp, Homo sapiens
gtctcgctccttcaaaacagtcttaattaactttcatattagcagattaaactagcagag

SEQ ID NO: 751 - DNA, 60 bp, Homo sapiens
gcaataatgtgtgtggctggtattggacttgttgtattattcttcagttggatgctctct

SEQ ID NO: 752 - DNA, 60 bp, Homo sapiens
ttatgagatgcttcagttcaaataacagtgcagtaattcacctatatctaaaagactgcc

SEQ ID NO: 753 - DNA, 60 bp, Homo sapiens
ccaccagaaacgtacacctgattttcatgacaaatacggtagcaacacaagtcggaatag

SEQ ID NO: 754 - DNA, 60 bp, Homo sapiens
tgatggaactataacaacagaatcaggaactgtaatgaggtctcttgggcagaatcccac

SEQ ID NO: 755 - DNA, 60 bp, Homo sapiens
gctcctgtcaagtggttctgcttggtttgccataatcctcatggttgttacatgtctatt

SEQ ID NO: 756 - DNA, 60 bp, Homo sapiens
atttcaaatgcagaatacttgactcatttaaagctaaattttgttactgattcaattata

SEQ ID NO: 757 - DNA, 60 bp, Homo sapiens
gcctaattgaaatatgtactcttattttagacacgcctctgttaaaacagaccaggtttt

SEQ ID NO: 758 - DNA, 60 bp, Homo sapiens
gataccattttggttaaaggaaatgctgcggccaacatcttcaaaaactgtctaaaagaa

SEQ ID NO: 759 - DNA, 60 bp, Homo sapiens
agcagcacaggaatcttacttcttggcagctgcagtctgtcaagatgagacatcagatta

SEQ ID NO: 760 - DNA, 60 bp, Homo sapiens
ttaacttggcaaggcttccttccgtgtttatccctgtagccatcatttaagtcaggaaca

SEQ ID NO: 761 - DNA, 60 bp, Homo sapiens
ggaataagttcctgcattataagtataaagggaaccgagatttaatttggagatcatcac

SEQ ID NO: 762 - DNA, 60 bp, Homo sapiens
aaacgtccctttggtgtttcattgctgtacattggctgggataagcactatggctttcag

SEQ ID NO: 763 - DNA, 60 bp, Homo sapiens
agcctccaaccacactaacaagattcaagattacttgcaacagctcacaggagcgagaat

SEQ ID NO: 764 - DNA, 60 bp, Homo sapiens
ctatgccctggttattctaatcccaattacatgtacttagcaaagtgttatactgatctt

SEQ ID NO: 765 - DNA, 60 bp, Homo sapiens
tccgcttcagaaggtttttcagactgagagcctaagcatactggatctgttgtttctttt

SEQ ID NO: 766 - DNA, 60 bp, Homo sapiens
ggatgaattgtaaaagcaacatcagcttgaccagtataaaattacagtggattgctcatc

SEQ ID NO: 767 - DNA, 60 bp, Homo sapiens
tgtggttgctggtgtgtgtaattattaatgaaatgttcactcctagtcccttatgaggct

SEQ ID NO: 768 - DNA, 60 bp, Homo sapiens
caaacagctcacagtcaaggaagctgtgttgaatgtttcagaggtcactggggtgtggat

SEQ ID NO: 769 - DNA, 60 bp, Homo sapiens
ctgtactgtaacacagcctgtaaagttagccatataaatgcaagggtatatcatatatac

SEQ ID NO: 770 - DNA, 60 bp, Homo sapiens
ttctgttctgttctgagtatcacccaaaaaccaaaggagaacatcctgtccagtccacta

SEQ ID NO: 771 - DNA, 60 bp, Homo sapiens
caaccagcgatacgtaatcaaaatgtaattttcccctaataaaattatggatatgggcag

SEQ ID NO: 772 - DNA, 60 bp, Homo sapiens
tgccaatgtactggcagattaacatacaacctatgttttgaacaaaaacaaccagcgata

SEQ ID NO: 773 - DNA, 60 bp, Homo sapiens
aagtagatgtggatgactgtcaggatgttgcttcagagtgtgaagtcaaatgcacgccaa

SEQ ID NO: 774 - DNA, 60 bp, Homo sapiens
gagaggagacttcgatgagaatctgaattatccagaacagaaagttgtgactgttggaca

SEQ ID NO: 775 - DNA, 60 bp, Homo sapiens
cattcattcagctctctatggaccagaaatctgataaatgagttcttctttggggatcaa

SEQ ID NO: 776 - DNA, 60 bp, Homo sapiens
caatgtgtatgcacattctctttagttaaggcaccaattgttttggttggttttcctaag

SEQ ID NO: 777 - DNA, 60 bp, Homo sapiens
tgagaatttacaagaccagctagtggacatgatggaagatgcaaatgaaatccaagaagc

SEQ ID NO: 778 - DNA, 60 bp, Homo sapiens
acagcttaacaatccttaagaagttagctgaacagttcccatggcaagtcttggacagta

SEQ ID NO: 779 - DNA, 60 bp, Homo sapiens
tattccatgtatcgggaattctgggcaaaacctaagccttagaagaagagatgctgtctt

SEQ ID NO: 780 - DNA, 60 bp, Homo sapiens
ttggacaatgaaaatgccttaaaaggaatgcatatggataaagttgcacttataacaccc

SEQ ID NO: 781 - DNA, 60 bp, Homo sapiens
attggaattcaagtaaatacaactgttccactcaacatgccgacctaactataattgaca

SEQ ID NO: 782 - DNA, 60 bp, Homo sapiens
ggttgcatacttttattggagtaaatctgaatgatcctactcctttggagtaagactagt

SEQ ID NO: 783 - DNA, 60 bp, Homo sapiens
gttgtggattctttccatcaactgctgatttcatcttcaggaagcaagtccataacatga

SEQ ID NO: 784 - DNA, 60 bp, Homo sapiens
cgcagtaatgttctgcacaacagtattgtaattgtaatggaatcataacctgctaactag

SEQ ID NO: 785 - DNA, 60 bp, Homo sapiens
ctcactgttggacatacattccaagcttttcaactctaggagaaaaagaaaatcatgttt

SEQ ID NO: 786 - DNA, 60 bp, Homo sapiens
ttctggtcattaagggaaagatcgaactggaagaaacaattaaagtatggaagcagcgga

SEQ ID NO: 787 - DNA, 60 bp, Homo sapiens
agagctgtcacacaccttaataatgtcaaattatttgggaaaagacttaatgtttgcgtg

SEQ ID NO: 788 - DNA, 60 bp, Homo sapiens
caccatgagggagttgtccaaagaaatgatgaaggctgggatcatagaggagatgttaga

SEQ ID NO: 789 - DNA, 60 bp, Homo sapiens
gtatggttggatgtactggaaaagtcataggaattgatcacattaaagagctagtagatg

SEQ ID NO: 790 - DNA, 60 bp, Homo sapiens
tatcgatgggaaaaagaagatgagcactgtggtgaactccaaggaagtgagtaagtttca

SEQ ID NO: 791 - DNA, 60 bp, Homo sapiens
tgacttcaccacagaaactttagaatgggggctcagttgttctgacattcttaattacag

SEQ ID NO: 792 - DNA, 60 bp, Homo sapiens
acccatggaacaatatgcttaggattacaggaagcagtccttacttacacttcttgtctg

SEQ ID NO: 793 - DNA, 60 bp, Homo sapiens
caaaatgtaacccatacatggattctccacaatcaataggtttccaagcaacaatcagtg

SEQ ID NO: 794 - DNA, 60 bp, Homo sapiens
ctctctgatgtccaggaggagaaaggcattaagtacaaatttgaagtatatgagaagaat

SEQ ID NO: 795 - DNA, 60 bp, Homo sapiens
cagaaaaacctgtaaagaaacaaaagacaggtgagacttcgagagccctgtcatcttcta

SEQ ID NO: 796 - DNA, 60 bp, Homo sapiens
agaatctttcccttgctagaccccagaattttaaatgcatccgtcttacactttcacaaa

SEQ ID NO: 797 - DNA, 60 bp, Homo sapiens
gcaatataaggcagctaattgcaaatacaagtatggctatttcctgtggacatgctgtgt

SEQ ID NO: 798 - DNA, 60 bp, Homo sapiens
attttccctcttttgttgggaagctcattttagtttaaccatgtttgttttgttggtagc

SEQ ID NO: 799 - DNA, 60 bp, Homo sapiens
ttgatccagtaggtgttgattatattcttcaaaaattgggctttcatcatgctaggacta

SEQ ID NO: 800 - DNA, 60 bp, Homo sapiens
acagcagcagcagccttgcttctatgagcagtttctggagtgtgcccagaaccagggtga

SEQ ID NO: 801 - DNA, 60 bp, Homo sapiens
ttttggcgtatacagcgcatgcttgctatcaccgcaaatactttaaggcaacaacttaca

SEQ ID NO: 802 - DNA, 60 bp, Homo sapiens
catgaaccccatgaaattatttgtagacttgtatgtacatttttctggggagaaggttca

SEQ ID NO: 803 - DNA, 60 bp, Homo sapiens
tggtgctattgtgcagtaactaatagtactcttaccagaggagaaattatattaacgacc

SEQ ID NO: 804 - DNA, 60 bp, Homo sapiens
ctccacattcaggtgtaaaatactagacagacatctggcaatattgtccaagaaacacct

SEQ ID NO: 805 - DNA, 60 bp, Homo sapiens
accagtttcagcctaaaaacttctggaatggtcgttggagatcagagtggaagttcacca

SEQ ID NO: 806 - DNA, 60 bp, Homo sapiens
gttgtatgcagcagaaatgatacctaaactaaaaacaaggacacaaaaaacaggaggtgc

SEQ ID NO: 807 - DNA, 60 bp, Homo sapiens
tactttttgtcgctggaacgaacttgatcagttcatcaataagtttttcctaaacggtgt

SEQ ID NO: 808 - DNA, 60 bp, Homo sapiens
tccatgtagacaaggttcacagtattcttgcagaaataatggggggaatggtattggaga

SEQ ID NO: 809 - DNA, 60 bp, Homo sapiens
gtattaggttaggtcacaaaggttttatctgaggtgatttaaataacttcctgattggag

SEQ ID NO: 810 - DNA, 60 bp, Homo sapiens
accagctaatatatggattgggatctttggctctggagaaaaagctggtatcaaggtgcc

SEQ ID NO: 811 - DNA, 60 bp, Homo sapiens
tctttggtccttgttctaccctaaactttgtatcacctgaaattaaaccaactcatttga

SEQ ID NO: 812 - DNA, 60 bp, Homo sapiens
atgatgagtgattcttgggaagataaatgttaatgttcccaatagtcaagcttgttttgc

SEQ ID NO: 813 - DNA, 60 bp, Homo sapiens
aacagaaaataagtagtttttgtgaatgacttgcagacaaagtagaaactgtgctgcatg

SEQ ID NO: 814 - DNA, 60 bp, Homo sapiens
tgctgttgatgctggctttgttcccaatgacatgcaagttggacagacgggaaaaatagt

SEQ ID NO: 815 - DNA, 60 bp, Homo sapiens
tatttctatggtaaatccttgcaaacatggaaacaatgcatttggcccagtgctttgtgg

SEQ ID NO: 816 - DNA, 60 bp, Homo sapiens
ttatgcccagttacatacaaggatcctgccatatttcagggaccctaaagtttataacat

SEQ ID NO: 817 - DNA, 60 bp, Homo sapiens
ccaagagtgatgagatgaatgtgaaggtgctggactttgagcactttctgcccatgctgc

SEQ ID NO: 818 - DNA, 60 bp, Homo sapiens
ctgcaaatggtgtggtattagcactgagaagacacagaaatccattctgtatgatgagca

SEQ ID NO: 819 - DNA, 60 bp, Homo sapiens
acctgaaatgcacttttaaatgtttgccttatatccaagtgtttacttgtatccatgacc

SEQ ID NO: 820 - DNA, 60 bp, Homo sapiens
gcttgactaaccccagattatctttcaagactttaatctgatcttgtgtcttagagaagc

SEQ ID NO: 821 - DNA, 60 bp, Homo sapiens
aagaacattacccgaatggagtctgcactgtaagtcatcagtagcagctttgtgtgtgtg

SEQ ID NO: 822 - DNA, 60 bp, Homo sapiens
atcctcaggtcctcgattaccctccaaactatattttattccttaataacttaccagaag

SEQ ID NO: 823 - DNA, 60 bp, Homo sapiens
ggtaaaacagacatgaatacatttcccaacttcaaatttgaagatcccaaatctgaagtc

SEQ ID NO: 824 - DNA, 60 bp, Homo sapiens
aaggtaaagcctagaagaaactatgaaagctattctcatgttaccaaattctatctgcgc

SEQ ID NO: 825 - DNA, 60 bp, Homo sapiens
gttttcgttactggatgtttggagtagatactggtctgtgattggtggaatggagaacac

SEQ ID NO: 826 - DNA, 60 bp, Homo sapiens
ttcttttgatgttgcaacttttgggttcttttaaactgtgatagtgatggtaactgatgc

SEQ ID NO: 827 - DNA, 60 bp, Homo sapiens
tttaaccagacgtctgcaccctttttcctgatatactgaggacactcggtctctagcaat

SEQ ID NO: 828 - DNA, 60 bp, Homo sapiens
tctagttccaaggaaaaaattcccagcgttttctacattcggtgctgcgtcatctgaaat

SEQ ID NO: 829 - DNA, 60 bp, Homo sapiens
aagtcttaaaagtcaaccgttaatcattaagtcttttgcctctaaagtcttttgcctctg

SEQ ID NO: 830 - DNA, 60 bp, Homo sapiens
tggtatattcaactacagctttctaaggataggactactttcatgtctagtaatacactg

SEQ ID NO: 831 - DNA, 60 bp, Homo sapiens
tgctttgattccagctttgatgttcacaagaagtgtcccctctgtgagttaatgtttcct

SEQ ID NO: 832 - DNA, 60 bp, Homo sapiens
aattagagaaacattctgtgtgtttgataaggatggcaatggctatattagtggtgtaga

SEQ ID NO: 833 - DNA, 60 bp, Homo sapiens
tatgaggaaatagtatcatcatgttagaagccttggaatgagtataaataatggctggtc

SEQ ID NO: 834 - DNA, 60 bp, Homo sapiens
aaatttgtcaggaaggagatgggaactctagatgtgcacaactgataccaggctcaacaa

SEQ ID NO: 835 - DNA, 60 bp, Homo sapiens
catcactaaagaagcgaagaaagctaccgtgaatttactgggtgaagaaaagaagagcac

SEQ ID NO: 836 - DNA, 60 bp, Homo sapiens
agctggaattgagacggaaacagtttcatgttcttcttagtaccatccatgaacttcagc

SEQ ID NO: 837 - DNA, 60 bp, Homo sapiens
agagagctcaaacaatggggtttatgccagttacatacaaggatcctgcatatttcaggg

SEQ ID NO: 838 - DNA, 60 bp, Homo sapiens
gcgttgactcggaggaaaatatctaaaaattcccggctcgccgtaggggtcctgtggttt

SEQ ID NO: 839 - DNA, 60 bp, Homo sapiens
ttgatacctctgattctgatgacaaacgccaatttgggttctgcaggtacatagaagttg

SEQ ID NO: 840 - DNA, 60 bp, Homo sapiens
gttggtaaatgttacttatattgggactagtattttctaatgtttctgggatatgctccc

SEQ ID NO: 841 - DNA, 60 bp, Homo sapiens
gagtggtgtctagatttctaatgaagaatcatgatacagtttggattaagtatcttggac

SEQ ID NO: 842 - DNA, 60 bp, Homo sapiens
gaagagaaacctgatggccttatcaatgaagctactagacaagttgctttggcagatgcc

SEQ ID NO: 843 - DNA, 60 bp, Homo sapiens
aagtcctgaataagtctactggaagaattattcttctgggtgaaaaagcttttgtttgtg

SEQ ID NO: 844 - DNA, 60 bp, Homo sapiens
gtctatttcaaattcagcttgtccactaggtcagttttacaggagatggtcttttaacat

SEQ ID NO: 845 - DNA, 60 bp, Homo sapiens
aaagcaagatcttatccacagactccaggcatatcttgaagaacatgctgaagaggaggc

SEQ ID NO: 846 - DNA, 60 bp, Homo sapiens
tccttagtgagttttaaatctcaggctagatttttatttgtttttctgtgtgtgtatgag

SEQ ID NO: 847 - DNA, 60 bp, Homo sapiens
atgtctatgctgtttcactatgctgcaaatattcccagccttttccccttgatgcccaaa

SEQ ID NO: 848 - DNA, 60 bp, Homo sapiens
atataaccttggaattctattctaattatgttgttctggctgcttgtagtatcagttcgc

SEQ ID NO: 849 - DNA, 60 bp, Homo sapiens
agaacaaagtaattttctgaagggaagctgcagaatatggaaaacatatattggagctac

SEQ ID NO: 850 - DNA, 60 bp, Homo sapiens
aggtagttcgaggacactacaaaggtcagcaaattggcaaggtaatccaggtgtacagaa

SEQ ID NO: 851 - DNA, 60 bp, Homo sapiens
ttcggaatgtctggaacatttcatttcctgttttgttacctgtggctctgtaaatctact

SEQ ID NO: 852 - DNA, 60 bp, Homo sapiens
ttagagaagcccccatacctggtagagcatgtaccatcttacatgcttaaataactccac

SEQ ID NO: 853 - DNA, 60 bp, Homo sapiens
ttccttcgctttttcttaagggtttctggaacagcaggaacctccttcttcttctcttct

SEQ ID NO: 854 - DNA, 60 bp, Homo sapiens
gaatggaggaagaagatgtgattgaggtttatcaggaacaaatcggaggtcattcaacag

SEQ ID NO: 855 - DNA, 60 bp, Homo sapiens
aatgctgttttgagattctgaaattaaatgaaaatacttatttcagaaatgcatttaatg

SEQ ID NO: 856 - DNA, 60 bp, Homo sapiens
aggaagaaaaggtatttctttaaatccagaacaatggagccagctgacagaacagatttc

SEQ ID NO: 857 - DNA, 60 bp, Homo sapiens
aattcttggtccctccgtggagaaactcttcagatggtcattgtgtacctactctctctt

SEQ ID NO: 858 - DNA, 60 bp, Homo sapiens
atttctctttctaaaggggagtaactttttaaacccttcctgattttagcctggcaatgt

SEQ ID NO: 859 - DNA, 60 bp, Homo sapiens
caaaaaggaggttgaaaattcacaggctgcccgaaaaaagaagaaacttgcatgggggtt

SEQ ID NO: 860 - DNA, 60 bp, Homo sapiens
aaagtgggaagatacgattcaagtcctggattctcgtctttggaaaaaggtcagtcctca

SEQ ID NO: 861 - DNA, 60 bp, Homo sapiens
ttgttgttagtttaccagatccgtgatgccacttacctgtgtgtttggtaacaacaaaca

SEQ ID NO: 862 - DNA, 60 bp, Homo sapiens
gaaggagataaggttcgacttacattcttcacactgtcaaaaaatggagaaaaactacag

SEQ ID NO: 863 - DNA, 60 bp, Homo sapiens
tgtgatgtaactgatgtaaccattgacaatctatgtgtgcctttatacatttcatctctg

SEQ ID NO: 864 - DNA, 60 bp, Homo sapiens
tttctttgttttggacaatctcataagaactttaggtcttacagcacgaacccctcgaag

SEQ ID NO: 865 - DNA, 60 bp, Homo sapiens
cctcagtactgtcactacaatattacattctgcaaatgttattctgttgtatcagatacg

SEQ ID NO: 866 - DNA, 60 bp, Homo sapiens
attggatgctgagctagtgaagtataaggaccagatcaagatgagagggggtcctacaaa

SEQ ID NO: 867 - DNA, 60 bp, Homo sapiens
ggagaataactcattctggttcttgtttccccttttccacataaaagtatatttgtcttg

SEQ ID NO: 868 - DNA, 60 bp, Homo sapiens
gtcttactttgagttagtgccataacagaccactgtatgtttacttctcaccatttgagt

SEQ ID NO: 869 - DNA, 60 bp, Homo sapiens
agcttgttttgtttcatcctgtccgtaaggggtcagcgctcttgctttgctcttttcaat

SEQ ID NO: 870 - DNA, 60 bp, Homo sapiens
cccacaagagcgtatgcaaatctctaagtttacgggactctcaatgaccactatcagtca

SEQ ID NO: 871 - DNA, 60 bp, Homo sapiens
tggaaagtgaagtgaaggatttttgtcatacagccagtaagtgccagaactgacttgaac

SEQ ID NO: 872 - DNA, 60 bp, Homo sapiens
agcttttgatcttggggccagaggccgccttacacacaccccaggtgtccatggggagca

SEQ ID NO: 873 - DNA, 60 bp, Homo sapiens
ggagtattccaccaaagaagataaatatgaagaggagatcaaactgttggaggagaagct

SEQ ID NO: 874 - DNA, 60 bp, Homo sapiens; identical to SEQ ID NO: 168

SEQ ID NO: 875 - DNA, 60 bp, Homo sapiens; identical to SEQ ID NO: 184

SEQ ID NO: 876 - DNA, 60 bp, Homo sapiens
tcctgctgctgtgaagatgagaaggtgctcttactcagttaatgatgagtgactatattt

SEQ ID NO: 877 - DNA, 60 bp, Homo sapiens; identical to SEQ ID NO: 190

SEQ ID NO: 878 - DNA, 60 bp, Homo sapiens
ctgaggttataattttcacttaacattgtcgagttggcattttggttttagtccaatggt

SEQ ID NO: 879 - DNA, 60 bp, Homo sapiens
atgtctggtgagaatccatcctctgtgagcatctctgtcatcagcagtagcagctacagc

SEQ ID NO: 880 - DNA, 60 bp, Homo sapiens; identical to SEQ ID NO: 211

SEQ ID NO: 881 - DNA, 60 bp, Homo sapiens; identical to SEQ ID NO: 220

SEQ ID NO: 882 - DNA, 60 bp, Homo sapiens
tgaaagtcttcatcgtgccggtggggaaccattccaacatcccattcagcagggtgaacc

SEQ ID NO: 883 - DNA, 60 bp, Homo sapiens; identical to SEQ ID NO: 306

SEQ ID NO: 884 - DNA, 60 bp, Homo sapiens; identical to SEQ ID NO: 353

SEQ ID NO: 885 - DNA, 60 bp, Homo sapiens
ccacctaccaccacctgctggaagatgaggacttcaatcttagcgatgccctggacagca

SEQ ID NO: 886 - DNA, 60 bp, Homo sapiens
tgttccttttaatgtagcgcagctcctatacttcagatttaactttgaaatgtagcatag

SEQ ID NO: 887 - DNA, 60 bp, Homo sapiens; identical to SEQ ID NO: 395

SEQ ID NO: 888 - DNA, 60 bp, Homo sapiens
cttctgttgtttctcaataaagtagacaagtccatctgatgggtgtttagtagggtatga

SEQ ID NO: 889 - DNA, 60 bp, Homo sapiens; identical to SEQ ID NO: 400

SEQ ID NO: 890 - DNA, 60 bp, Homo sapiens
aaccctgtgctgtggcataacctctctacattttcccatgagctgtgctgatcaaactaa

SEQ ID NO: 891 - DNA, 60 bp, Homo sapiens
attctccatatattttagtgttgttctattggctagaaagacaaaacaaggggaatctgg

SEQ ID NO: 892 - DNA, 60 bp, Homo sapiens
atcacaactatgccaaataatcaatcctacaatgtccaaaattttactttaaaactggaa

SEQ ID NO: 893 - DNA, 60 bp, Homo sapiens; identical to SEQ ID NO: 418

SEQ ID NO: 894 - DNA, 60 bp, Homo sapiens; identical to SEQ ID NO: 422

SEQ ID NO: 895 - DNA, 60 bp, Homo sapiens; identical to SEQ ID NO: 423

SEQ ID NO: 896 - DNA, 60 bp, Homo sapiens
atgctaacggtggagactaaggcatacaagtatgactagaattgccagctacacattaga

SEQ ID NO: 897 - DNA, 60 bp, Homo sapiens
aaaccattggtcccttttacccagggaaggactcaagaagccgaacgtgataggagatgg

SEQ ID NO: 898 - DNA, 60 bp, Homo sapiens; identical to SEQ ID NO: 431

SEQ ID NO: 899 - DNA, 60 bp, Homo sapiens
aatgtagcatgagtgttgccggtttaaaagccgtgtttgagtactctaaagtacttttct

SEQ ID NO: 900 - DNA, 60 bp, Homo sapiens; identical to SEQ ID NO: 434

SEQ ID NO: 901 - DNA, 60 bp, Homo sapiens
tgttatgaacatagttcatgttaagtctccatttaaatacaacctgaaataccaaagtta

SEQ ID NO: 902 - DNA, 60 bp, Homo sapiens; identical to SEQ ID NO: 441

SEQ ID NO: 903 - DNA, 60 bp, Homo sapiens; identical to SEQ ID NO: 442

SEQ ID NO: 904 - DNA, 60 bp, Homo sapiens
tccccatctggagtatggtttggaagtcattgctttgtagtaaggcattattttcctggt

SEQ ID NO: 905 - DNA, 60 bp, Homo sapiens; identical to SEQ ID NO: 445

SEQ ID NO: 906 - DNA, 60 bp, Homo sapiens
cacctccacctttatacttatgctttatacctgcagaactataacctaagggaaggaatg

SEQ ID NO: 907 - DNA, 60 bp, Homo sapiens; identical to SEQ ID NO: 446

SEQ ID NO: 908 - DNA, 60 bp, Homo sapiens; identical to SEQ ID NO: 447

SEQ ID NO: 909 - DNA, 60 bp, Homo sapiens
gtgccaaggtaagctaccacttttggttttattttcaagcacaacatgaaataagcattc

SEQ ID NO: 910 - DNA, 60 bp, Homo sapiens; identical to SEQ ID NO: 459

SEQ ID NO: 911 - DNA, 60 bp, Homo sapiens; identical to SEQ ID NO: 462

SEQ ID NO: 912 - DNA, 60 bp, Homo sapiens
cagattagaccacctcataatgagttcttgattgcacttcagattgtcttgatggggcac

SEQ ID NO: 913 - DNA, 60 bp, Homo sapiens; identical to SEQ ID NO: 467

SEQ ID NO: 914 - DNA, 60 bp, Homo sapiens; identical to SEQ ID NO: 469

SEQ ID NO: 915 - DNA, 60 bp, Homo sapiens
aaatggaagtattgaccagattaaagagtggttaagtcatggccatgaatgaatttacca

SEQ ID NO: 916 - DNA, 60 bp, Homo sapiens; identical to SEQ ID NO: 472

SEQ ID NO: 917 - DNA, 60 bp, Homo sapiens; identical to SEQ ID NO: 473

SEQ ID NO: 918 - DNA, 60 bp, Homo sapiens
taatgagctcttttcggcatgaaggcaaggaactgtccagaagacctctggagaattctt

SEQ ID NO: 919 - DNA, 60 bp, Homo sapiens; identical to SEQ ID NO: 474

SEQ ID NO: 920 - DNA, 60 bp, Homo sapiens; identical to SEQ ID NO: 483

SEQ ID NO: 921 - DNA, 60 bp, Homo sapiens; identical to SEQ ID NO: 487

SEQ ID NO: 922 - DNA, 60 bp, Homo sapiens; identical to SEQ ID NO: 493

SEQ ID NO: 923 - DNA, 60 bp, Homo sapiens
tgtgaccgtttgtgacgagttatctcagtcctcacatgagttcttacatgagtccctcta

SEQ ID NO: 924 - DNA, 60 bp, Homo sapiens
agaccacagaaacatagacccatgatatttggaccaagcataggttaaaactaggggagg

SEQ ID NO: 925 - DNA, 60 bp, Homo sapiens; identical to SEQ ID NO: 503

SEQ ID NO: 926 - DNA, 60 bp, Homo sapiens; identical to SEQ ID NO: 505

SEQ ID NO: 927 - DNA, 60 bp, Homo sapiens; identical to SEQ ID NO: 506

SEQ ID NO: 928 - DNA, 60 bp, Homo sapiens; identical to SEQ ID NO: 507

SEQ ID NO: 929 - DNA, 60 bp, Homo sapiens; identical to SEQ ID NO: 508

SEQ ID NO: 930 - DNA, 60 bp, Homo sapiens; identical to SEQ ID NO: 510

SEQ ID NO: 931 - DNA, 60 bp, Homo sapiens
acaccagtctaactctagcttaatgagccatggaaacaaaatagctcaatctcttctaac

SEQ ID NO: 932 - DNA, 60 bp, Homo sapiens; identical to SEQ ID NO: 515

SEQ ID NO: 933 - DNA, 60 bp, Homo sapiens; identical to SEQ ID NO: 517

SEQ ID NO: 934 - DNA, 60 bp, Homo sapiens
ggctctgggcaccattggaagactgcagatataaatgacaagtgatttattttgttttca

SEQ ID NO: 935 - DNA, 60 bp, Homo sapiens
tgttggaataccggcggtgatctgtcttttataaactcacctgatttaaaggaaagatga

SEQ ID NO: 936 - DNA, 60 bp, Homo sapiens; identical to SEQ ID NO: 520

SEQ ID NO: 937 - DNA, 60 bp, Homo sapiens; identical to SEQ ID NO: 523

SEQ ID NO: 938 - DNA, 60 bp, Homo sapiens
aggggcagaaatatttgggttcctccgtttattagtaaagtgtctttggactattgtctc

SEQ ID NO: 939 - DNA, 60 bp, Homo sapiens
cttatcctttccttttgtggtgtcaacctgccaacattgtgggctcattctttctggcta

SEQ ID NO: 940 - DNA, 60 bp, Homo sapiens; identical to SEQ ID NO: 525

SEQ ID NO: 941 - DNA, 60 bp, Homo sapiens; identical to SEQ ID NO: 530

SEQ ID NO: 942 - DNA, 60 bp, Homo sapiens
gcagaagtacaagctttagggtgtatctattcatctattcctagtacataaaatttagcc

SEQ ID NO: 943 - DNA, 60 bp, Homo sapiens; identical to SEQ ID NO: 535

SEQ ID NO: 944 - DNA, 60 bp, Homo sapiens
ctccacttatatttattctgcacctacctgcacgtgacactctgctattcttcagagaag

SEQ ID NO: 945 - DNA, 60 bp, Homo sapiens; identical to SEQ ID NO: 537

SEQ ID NO: 946 - DNA, 60 bp, Homo sapiens; identical to SEQ ID NO: 538

SEQ ID NO: 947 - DNA, 60 bp, Homo sapiens; identical to SEQ ID NO: 541

SEQ ID NO: 948 - DNA, 60 bp, Homo sapiens; identical to SEQ ID NO: 548

SEQ ID NO: 949 - DNA, 60 bp, Homo sapiens
ttcatggagcttctagtcaagcgagacgcactaaacagtaaagggacaaataggattact

SEQ ID NO: 950 - DNA, 60 bp, Homo sapiens; identical to SEQ ID NO: 549

SEQ ID NO: 951 - DNA, 60 bp, Homo sapiens; identical to SEQ ID NO: 550

SEQ ID NO: 952 - DNA, 60 bp, Homo sapiens; identical to SEQ ID NO: 554

SEQ ID NO: 953 - DNA, 60 bp, Homo sapiens
gtatcatccaaataatggggcctatgacttgaatgaatagaaatgaataagctggtgttt

SEQ ID NO: 954 - DNA, 60 bp, Homo sapiens; identical to SEQ ID NO: 556

SEQ ID NO: 955 - DNA, 60 bp, Homo sapiens
taaatttctttcctgtctgcacaattagctattcagagcaagagggcctgattttataga

SEQ ID NO: 956 - DNA, 60 bp, Homo sapiens
atgttttcaccctttctactttgtcagaaacactgaacagagttttgtcttttctaatcc

SEQ ID NO: 957 - DNA, 60 bp, Homo sapiens
attgtgttggttgttttaaatgtcgtctgtggggaaagcttcagactcagggtttgggca

SEQ ID NO: 958 - DNA, 60 bp, Homo sapiens; identical to SEQ ID NO: 557

SEQ ID NO: 959 - DNA, 60 bp, Homo sapiens
gcctctcccagtttactttaaaaatggctttaaggataaagaataaatgtgatagctgtg

SEQ ID NO: 960 - DNA, 60 bp, Homo sapiens
actgagacaagttgtggaagtttcttaatctgacagtggtttcagtgtgtaccttatctt

SEQ ID NO: 961 - DNA, 60 bp, Homo sapiens
ctcttgaaaagcagactttcagtctgttggactcttcaaaccaggttcttgaatacttaa

SEQ ID NO: 962 - DNA, 60 bp, Homo sapiens; identical to SEQ ID NO: 558

SEQ ID NO: 963 - DNA, 60 bp, Homo sapiens
agcctctggaagtggatcaaactagaactcatatgccatactagatatgtttgtcaataa

SEQ ID NO: 964 - DNA, 60 bp, Homo sapiens
gtctcaagaatgcatctgtcaagttttttagactgaccagtagcttaaacttttttcagg

SEQ ID NO: 965 - DNA, 60 bp, Homo sapiens
ttgggcatggactaatttgtatctgtttaactcatattctgcacgatctgtatatagtac

SEQ ID NO: 966 - DNA, 60 bp, Homo sapiens
gaaatggcagcagtttctgatgctgaggcagtttgcaatcccatgacaactggatttaaa

SEQ ID NO: 967 - DNA, 60 bp, Homo sapiens
aagtgaaggaccacttctcatattagattactaagtcatttgtatgaatatgtgtggcag

SEQ ID NO: 968 - DNA, 60 bp, Homo sapiens
aattatgttcctgaggtctcagccttggatcaggagattattgaagtagatcctgacact

SEQ ID NO: 969 - DNA, 60 bp, Homo sapiens; identical to SEQ ID NO: 561

SEQ ID NO: 970 - DNA, 60 bp, Homo sapiens
tatttctgtagattgttttcaggagaaagttttgcttctatggtaagagtgagcactttg

SEQ ID NO: 971 - DNA, 60 bp, Homo sapiens
tattttcgtctgaaggtaatgatagctatacagtctgtacagtaattatcctctaccaac

SEQ ID NO: 972 - DNA, 60 bp, Homo sapiens; identical to SEQ ID NO: 565

SEQ ID NO: 973 - DNA, 60 bp, Homo sapiens
tttggattcagaactcattttggtggtggcaagacaactggctttggcatgatttatgat

SEQ ID NO: 974 - DNA, 60 bp, Homo sapiens
tggaacacacactactccaatcaaagctgaaggagaagtccaacatgactaggaacatgc

SEQ ID NO: 975 - DNA, 60 bp, Homo sapiens; identical to SEQ ID NO: 568

SEQ ID NO: 976 - DNA, 60 bp, Homo sapiens
catgtgttactgttacaaaactttctctctccatgtaatcacacttagttatgagcaaag

SEQ ID NO: 977 - DNA, 60 bp, Homo sapiens
ttaaaacatgttggctacagtagcactttactgaagtagtattttttggtatctctagcc

SEQ ID NO: 978 - DNA, 60 bp, Homo sapiens; identical to SEQ ID NO: 569

SEQ ID NO: 979 - DNA, 60 bp, Homo sapiens
aaaccaaactgatctctctgggttggcttcagctgctgtaagtaaagatgattccattat

SEQ ID NO: 980 - DNA, 60 bp, Homo sapiens
cttccaaatcactggtttgggagggggtggatacatcctcattttctgtacatgatgcat

SEQ ID NO: 981 - DNA, 60 bp, Homo sapiens
ttggcctctttgtactggaaaagtattcagtggtacctggaggtctggacagttatactg

SEQ ID NO: 982 - DNA, 60 bp, Homo sapiens; identical to SEQ ID NO: 570

SEQ ID NO: 983 - DNA, 60 bp, Homo sapiens
gtggtttataaaggagaatagctattggggttagcattgcacaaagcccagtttctttct

SEQ ID NO: 984 - DNA, 60 bp, Homo sapiens
atccgttccactagctacaggtgagcattttacccattgttggataatggtaatctcttt

SEQ ID NO: 985 - DNA, 60 bp, Homo sapiens; identical to SEQ ID NO: 574

SEQ ID NO: 986 - DNA, 60 bp, Homo sapiens
gaacaagcaagattagacatactgaaaatccatgcaggtcccattacaaagcatggtgaa

SEQ ID NO: 987 - DNA, 60 bp, Homo sapiens; identical to SEQ ID NO: 579

SEQ ID NO: 988 - DNA, 60 bp, Homo sapiens
cagtgctagcaacttaatttctcatacatttatagagtttggtttgctttgctagttgtg

SEQ ID NO: 989 - DNA, 60 bp, Homo sapiens; identical to SEQ ID NO: 584

SEQ ID NO: 990 - DNA, 60 bp, Homo sapiens
agttgtatgtgcccccagtgctacatacgcaggtatgcgtaagtgtgtatgcttgtttta

SEQ ID NO: 991 - DNA, 60 bp, Homo sapiens
ctcctcaagccgtaatgttgaacagaattggagtattttctttataatttcttgaacagg

SEQ ID NO: 992 - DNA, 60 bp, Homo sapiens
cttcccttttttgatgtagatgcagatattctatacagttctgttgtcttttactaggac

SEQ ID NO: 993 - DNA, 60 bp, Homo sapiens
aggcttagtagctcagtctttaacaagggctagaaaagaatgtaatctgatatggaagga

SEQ ID NO: 994 - DNA, 60 bp, Homo sapiens; identical to SEQ ID NO: 588

SEQ ID NO: 995 - DNA, 60 bp, Homo sapiens
taaccccagtggaatacattaattcttaaagcggctcttttcagtagtgtgacttttaga

SEQ ID NO: 996 - DNA, 60 bp, Homo sapiens; identical to SEQ ID NO: 590

SEQ ID NO: 997 - DNA, 60 bp, Homo sapiens
gtcaaactagatggcagccggctcataaaggttcatttggacaaagcacagcagaacaat

SEQ ID NO: 998 - DNA, 60 bp, Homo sapiens
attggcttcgagtggttgcatctgacaaggagacctacgaacttcgttacttccagatta

SEQ ID NO: 999 - DNA, 60 bp, Homo sapiens; identical to SEQ ID NO: 594

SEQ ID NO: 1000 - DNA, 60 bp, Homo sapiens
ccaaatccggaagaagatgatggaaatcatgacccgagaggtgcagacaaatgacttgaa

SEQ ID NO: 1001 - DNA, 60 bp, Homo sapiens
aaacttctacaaaactctagtatgggcttctgactttttccagggtgtagaatttgactc

SEQ ID NO: 1002 - DNA, 60 bp, Homo sapiens
tagtggaccacttggaaataaaccattggacagatttcagtaatgtcttcagtggaacac

SEQ ID NO: 1003 - DNA, 60 bp, Homo sapiens; identical to SEQ ID NO: 595

SEQ ID NO: 1004 - DNA, 60 bp, Homo sapiens; identical to SEQ ID NO: 596

SEQ ID NO: 1005 - DNA, 60 bp, Homo sapiens
ttggacaacaaacgtcaagcaatgggaagccattttgatttcttgagtaatcttgtaagc

SEQ ID NO: 1006 - DNA, 60 bp, Homo sapiens
tctttgtacctccatacaagtgttagcctgccaggctgtaagcttaccttaattaaactt

SEQ ID NO: 1007 - DNA, 60 bp, Homo sapiens; identical to SEQ ID NO: 597

SEQ ID NO: 1008 - DNA, 60 bp, Homo sapiens; identical to SEQ ID NO: 598

SEQ ID NO: 1009 - DNA, 60 bp, Homo sapiens
tgtataataaaacacagggtttggaaggttttgttacagggagcatggtctgttgaagat

SEQ ID NO: 1010 - DNA, 60 bp, Homo sapiens; identical to SEQ ID NO: 601

SEQ ID NO: 1011 - DNA, 60 bp, Homo sapiens
ttaccttgttaacaagcatcaccaatgaacatttcagagcaatctgcatatttaacagac

SEQ ID NO: 1012 - DNA, 60 bp, Homo sapiens
ccccatcttgtaacctgttgcaagagtgaatgtaaaaaatagttgtggcattttaaaagg

SEQ ID NO: 1013 - DNA, 60 bp, Homo sapiens; identical to SEQ ID NO: 602

SEQ ID NO: 1014 - DNA, 60 bp, Homo sapiens
ctcagttcttaaattatctgggaagggtctggattctctatttttgagattgactttatc

SEQ ID NO: 1015 - DNA, 60 bp, Homo sapiens
tacccaatccccatgaacttgtttcagatttgctctgttagcacttttttctttgactca

SEQ ID NO: 1016 - DNA, 60 bp, Homo sapiens; identical to SEQ ID NO: 607

SEQ ID NO: 1017 - DNA, 60 bp, Homo sapiens; identical to SEQ ID NO: 608

SEQ ID NO: 1018 - DNA, 60 bp, Homo sapiens
aggtttggacctgccatattttgttttattctgtgatcctaactagttccttttaatagg

SEQ ID NO: 1019 - DNA, 60 bp, Homo sapiens
aagaaaaagcaatcgttcagcagtggttagaatacagggtcactcaagtagatgggcact

SEQ ID NO: 1020 - DNA, 60 bp, Homo sapiens
ggtctctcttgcttcaaaatatcttcttgtacagtactcaccattttagatgtggttgac

SEQ ID NO: 1021 - DNA, 60 bp, Homo sapiens; identical to SEQ ID NO: 609

SEQ ID NO: 1022 - DNA, 60 bp, Homo sapiens
caaatacggtaatgctgtattagctagtggagccactttctgtattgttacatggacata

SEQ ID NO: 1023 - DNA, 60 bp, Homo sapiens; identical to SEQ ID NO: 610

SEQ ID NO: 1024 - DNA, 60 bp, Homo sapiens
cttggtatgtggccatatttatagaatgctgaactcaatgtgcaagttgtactgtatgca

SEQ ID NO: 1025 - DNA, 60 bp, Homo sapiens
gaggtatttttcctaagtggtattgtacggtgtatactgttcttcagcttgtcttctctg

SEQ ID NO: 1026 - DNA, 60 bp, Homo sapiens
agtacaggatatatgaaatcttttcccagtatttcagaatgtacttaattcacaggcagg

SEQ ID NO: 1027 - DNA, 60 bp, Homo sapiens
ttaacggcttcactggacagttttccttagaaggtagttttgtgtgactgtgactaaact

SEQ ID NO: 1028 - DNA, 60 bp, Homo sapiens
ctgggtattgatgaagatgaccctactgctgatgataccagtgctgctgtaactgaagaa

SEQ ID NO: 1029 - DNA, 60 bp, Homo sapiens
tagtaatagggggaaaatgtcaattagtagcttaccacagatactgtttcctaccattta

SEQ ID NO: 1030 - DNA, 60 bp, Homo sapiens; identical to SEQ ID NO: 611

SEQ ID NO: 1031 - DNA, 60 bp, Homo sapiens
gaggatgctggaaacaacgtggaggtagatgagtctttgttccaagaaatggatgacttg

SEQ ID NO: 1032 - DNA, 60 bp, Homo sapiens
atggaaaggattcttggacctctaccaaaacatatgatacagaaaaccaggaaacgtaaa

SEQ ID NO: 1033 - DNA, 60 bp, Homo sapiens
aatttgtggatttctgatacaatgtcttctactgagccaccatcaaagcatgctgttact

SEQ ID NO: 1034 - DNA, 60 bp, Homo sapiens
ggaaacgaacaagttcatcttgagaatttatacacactggtcgagaagaagcatcctcag

SEQ ID NO: 1035 - DNA, 60 bp, Homo sapiens
gagcaacaacagatacaactgtactagaggctaatgcagttctcttgggaatccaggaga

SEQ ID NO: 1036 - DNA, 60 bp, Homo sapiens; identical to SEQ ID NO: 615

SEQ ID NO: 1037 - DNA, 60 bp, Homo sapiens
gtcaaagttagttcttagtgatcatatggtcagctaatattagttcttagtgatcagtgg

SEQ ID NO: 1038 - DNA, 60 bp, Homo sapiens; identical to SEQ ID NO: 616

SEQ ID NO: 1039 - DNA, 60 bp, Homo sapiens; identical to SEQ ID NO: 618

SEQ ID NO: 1040 - DNA, 60 bp, Homo sapiens
cagtagaaaaccatatggggactatagtgcaacctatttgggtaaagaaaccatttgcta

SEQ ID NO: 1041 - DNA, 60 bp, Homo sapiens
aggcttaaaaccaatgtcaccacttgggcttaactgggtaatttgtggtctaggcctttt

SEQ ID NO: 1042 - DNA, 60 bp, Homo sapiens
taaaaattggtaaactagaagtaacttgtccacaaccctcagttatgatacttatgtgcg

SEQ ID NO: 1043 - DNA, 60 bp, Homo sapiens
tagatttttaacaggtgtcatttgactaaacgtttcggtagaatgcttcatacttgagtg

SEQ ID NO: 1044 - DNA, 60 bp, Homo sapiens
gagccctttatcaatacagtgctgcaatttctggatatcagctacactttgtttttaagt

SEQ ID NO: 1045 - DNA, 60 bp, Homo sapiens; identical to SEQ ID NO: 619

SEQ ID NO: 1046 - DNA, 60 bp, Homo sapiens
agaccatgattgaacctcacattgatgtcaagactaccgatggttatttgtttcatctac

SEQ ID NO: 1047 - DNA, 60 bp, Homo sapiens
tgaaggccaagaggaagtcactgttaaaggactctgtgccatcttacaaccttggatgaa

SEQ ID NO: 1048 - DNA, 60 bp, Homo sapiens; identical to SEQ ID NO: 621

SEQ ID NO: 1049 - DNA, 60 bp, Homo sapiens
atgtttacaggtttgaattaggctaaaaggtcttgcagtggcttttcatggcccttcaaa

SEQ ID NO: 1050 - DNA, 60 bp, Homo sapiens
tgctcctttgtaaaaagttaaagatttgaaagagaatctcatattcccgaggcattagga

SEQ ID NO: 1051 - DNA, 60 bp, Homo sapiens
acagctattcccatattctaggagtggcctaagaaatgcgtgtttcagtgactagattat

SEQ ID NO: 1052 - DNA, 60 bp, Homo sapiens
tgattattcctacaagtgaaacactagactatttggagtgtatatggcttgtgttttggg

SEQ ID NO: 1053 - DNA, 60 bp, Homo sapiens
gtacataagaatctatcactaagtaatgtatccttcagaatgtgttggtttaccagtgac

SEQ ID NO: 1054 - DNA, 60 bp, Homo sapiens
tctgttggagtattttcttccttacgtcaatacttttcctgcattatttgaaattgtggg

SEQ ID NO: 1055 - DNA, 60 bp, Homo sapiens
ctataaggttgtactgctgggaaaatacaatgcacagggcttaggttcagatcatgaatt

SEQ ID NO: 1056 - DNA, 60 bp, Homo sapiens
gaccaggataaatgaggtatgttgatcatggctttgctttatatcttgatattaaagctg

SEQ ID NO: 1057 - DNA, 60 bp, Homo sapiens
gtataagatgttagattctgtaatcttcacattcattttagcaggtactgagtgatgctg

SEQ ID NO: 1058 - DNA, 60 bp, Homo sapiens
atttgtgcagaatgataaagaatgttccttttagaagtgtgttatgtctgtacctgtctg

SEQ ID NO: 1059 - DNA, 60 bp, Homo sapiens
caattcattgccagacttcattggaatgctttgtttgatgatgtatgttcattctcagct

SEQ ID NO: 1060 - DNA, 60 bp, Homo sapiens
ctaatgtagcagggggaagtatttaattgcccatgatatgtattttacttatactatgcc

SEQ ID NO: 1061 - DNA, 60 bp, Homo sapiens
gtaagtaccacttcaaaaaatagttctgtttactttctgcatggtatttcagtgtctgtc

SEQ ID NO: 1062 - DNA, 60 bp, Homo sapiens
ccaaaacagcaatttgaaattagaactagtggttttagagaactcaggtattctttcctg

SEQ ID NO: 1063 - DNA, 60 bp, Homo sapiens
ttagagaatcgttctagtgtttttgccgaagattaccgctggcctactgtgaagggagat

SEQ ID NO: 1064 - DNA, 60 bp, Homo sapiens
ccatactggacataaatcttacaaatgtcttaagtgtggcaaggtcttcagtctgtgggc

SEQ ID NO: 1065 - DNA, 60 bp, Homo sapiens
tcagaaaaatgtatactggggaaaagttgtatgaaggtggtgaacatgggagacttttag

SEQ ID NO: 1066 - DNA, 60 bp, Homo sapiens
tcatgtaaacggttaacaagcttaccaaggttagcaaaactttcattgtaaatcagtctg

SEQ ID NO: 1067 - DNA, 60 bp, Homo sapiens; identical to SEQ ID NO: 632

SEQ ID NO: 1068 - DNA, 60 bp, Homo sapiens
tcctgcgcaccttataccagaattcagtataatacactactttctgttttcaaacagata

SEQ ID NO: 1069 - DNA, 60 bp, Homo sapiens; identical to SEQ ID NO: 633

SEQ ID NO: 1070 - DNA, 60 bp, Homo sapiens
tgtaccctgttaacagccagtcattttgatttacttatggaaatcaagtgaataaaaggc

SEQ ID NO: 1071 - DNA, 60 bp, Homo sapiens
catatgcatcattggctacacttccatttttgtctactgttgttactgacaagctttttg

SEQ ID NO: 1072 - DNA, 60 bp, Homo sapiens
gtatgtaagttttctgtttgtgaaaatgtagttaatgtactcactgtggaggtcataagg

SEQ ID NO: 1073 - DNA, 60 bp, Homo sapiens
taaaagtggagtcactaaatagtttgcagtacgtttctaatataagtgtaggtgggtatc

SEQ ID NO: 1074 - DNA, 60 bp, Homo sapiens
catggttgtgatttcttccctgaacgctggtttcatatagtttttgtgctgagaacagat

SEQ ID NO: 1075 - DNA, 60 bp, Homo sapiens
aaacgtgttgctctcttcacagtattatgtgtaaagtcattgtttaaagcacgaatgttc

SEQ ID NO: 1076 - DNA, 60 bp, Homo sapiens
gttataggtcctttagaaacacataattaacacttaaggttgggtgctgctaattctttg

SEQ ID NO: 1077 - DNA, 60 bp, Homo sapiens
cagatgagttcatttgcttctgtagatgtgttttcagagctaggtacagaggaatgtttg

SEQ ID NO: 1078 - DNA, 60 bp, Homo sapiens
aacctacctccagattagtaaagccagttgaaaaactaaaagatcagcttcgagaagtct

SEQ ID NO: 1079 - DNA, 60 bp, Homo sapiens; identical to SEQ ID NO: 638

SEQ ID NO: 1080 - DNA, 60 bp, Homo sapiens
agtatacaggctttggagggcagtagagagcttgaaaatctcattggaatctcctgtgca

SEQ ID NO: 1081 - DNA, 60 bp, Homo sapiens
gagtaaactggaggactgtggctattcctgaaccttctttgagacagaatccctcagaat

SEQ ID NO: 1082 - DNA, 60 bp, Homo sapiens
gggcactgcttgtatagtctctcaagttcacaggaaatgttgattttctaaggtcctcat

SEQ ID NO: 1083 - DNA, 60 bp, Homo sapiens
taagcagtcattgtgtttgccagtaatgtttgagagacatgtaagttgaaagttttgcta

SEQ ID NO: 1084 - DNA, 60 bp, Homo sapiens
atgtcacgaagttcacctagctggttttaaatacaacttttctgacctcaagagtccttt

SEQ ID NO: 1085 - DNA, 60 bp, Homo sapiens
tgatgtattgagaattcagctccttaaaattggcagtgctatccagcgacttcgctgtga

SEQ ID NO: 1086 - DNA, 60 bp, Homo sapiens
gattcatgttcccttaactgacaatcataagaagccaactcgtacattcatgatacagat

SEQ ID NO: 1087 - DNA, 60 bp, Homo sapiens; identical to SEQ ID NO: 642

SEQ ID NO: 1088 - DNA, 60 bp, Homo sapiens
gtatgtcagttaattgtactacttggctgaatttccatatagtttttactgtgtatgggg

SEQ ID NO: 1089 - DNA, 60 bp, Homo sapiens; identical to SEQ ID NO: 644

SEQ ID NO: 1090 - DNA, 60 bp, Homo sapiens
caggattcctgatatagatgccagtcataatagatttcgagacaacagtggccttctgat

SEQ ID NO: 1091 - DNA, 60 bp, Homo sapiens; identical to SEQ ID NO: 645

SEQ ID NO: 1092 - DNA, 60 bp, Homo sapiens
gaaaagttttgagagggcactgtcaacttgggtttaagacaggaggacattgcaagttca

SEQ ID NO: 1093 - DNA, 60 bp, Homo sapiens
ttcatttcaatagcttgtttcatttgcacgcctttgtattttgattgacctgtagaatgg

SEQ ID NO: 1094 - DNA, 60 bp, Homo sapiens
ttttttattaactgcttttgcccatataacatgctgatatttactggaaacctagccagc

SEQ ID NO: 1095 - DNA, 60 bp, Homo sapiens
gctgttaccttctgaaactgtacctttataaatcaattgttttgcaaagaagttatggcc

SEQ ID NO: 1096 - DNA, 60 bp, Homo sapiens
ttagtttttagtgagtgctgtaggattaattcgaaaataggcagaattccattcctccca

SEQ ID NO: 1097 - DNA, 60 bp, Homo sapiens
atacttgccatttgagcctcactgcaaaattagtgcagaggagaaaacaatttttaatgt

SEQ ID NO: 1098 - DNA, 60 bp, Homo sapiens
aaagagtctgtacatcttcagagtttcagtcggcaatttcttggccatggatgtagaacc

SEQ ID NO: 1099 - DNA, 60 bp, Homo sapiens; identical to SEQ ID NO: 648

SEQ ID NO: 1100 - DNA, 60 bp, Homo sapiens
attagccaggtgaatgatccttgaaacatctctttcaggtctggagaaagagacagaatg

SEQ ID NO: 1101 - DNA, 60 bp, Homo sapiens
cttgcattccaggggagttttcttttgagtagtatgtttcttgtttgcatgttcctgttc

SEQ ID NO: 1102 - DNA, 60 bp, Homo sapiens; identical to SEQ ID NO: 650

SEQ ID NO: 1103 - DNA, 60 bp, Homo sapiens
gtactttgtgtttaatatatctgggtgatggatcacaacacatcaataaactgacttacc

SEQ ID NO: 1104 - DNA, 60 bp, Homo sapiens
gtgagcccaggtgttgcttgttcaatatcccaagcccagaaagatgagttcatccttaaa

SEQ ID NO: 1105 - DNA, 60 bp, Homo sapiens
catcagacttctgtttgatggcttacagcaaccagtactcaacaagcagctgacttatgt

SEQ ID NO: 1106 - DNA, 60 bp, Homo sapiens
gaagataagctccaggtcttatcgtatcccttgccatctgaacttgtttgcactgcttct

SEQ ID NO: 1107 - DNA, 60 bp, Homo sapiens
tgcttttttgatcaactggtttgtgttttgctgctgcatttatcccaagaaaaacagctt

SEQ ID NO: 1108 - DNA, 60 bp, Homo sapiens; identical to SEQ ID NO: 654

SEQ ID NO: 1109 - DNA, 60 bp, Homo sapiens
ggaaagcaaataatgcctactactccgacttttatagaagctacttttaaatcagaatat

SEQ ID NO: 1110 - DNA, 60 bp, Homo sapiens; identical to SEQ ID NO: 656

SEQ ID NO: 1111 - DNA, 60 bp, Homo sapiens
gagtctaaggccctagcgatttgggcatctgccacattggttcatattcagaaagtgtta

SEQ ID NO: 1112 - DNA, 60 bp, Homo sapiens
caattgtactggacagaatgaacatcaaagagaaaattcaggtcataggagagatcagat

SEQ ID NO: 1113 - DNA, 60 bp, Homo sapiens
gtctgatgtttacgggggagagtgtagttactaaaaatgtttaacataatttggaagaag

SEQ ID NO: 1114 - DNA, 60 bp, Homo sapiens
tgcctgtggctctaatatgcacctcaagattttaaggagataatgtttttagagagaatt

SEQ ID NO: 1115 - DNA, 60 bp, Homo sapiens
tgatgtattttcaaatagagttcaggatctgcaattcagttcaacacaagtttgttgagc

SEQ ID NO: 1116 - DNA, 60 bp, Homo sapiens
tcaataacggagtaaactgttccagataaagcaagaatagttgcaagaagtaaattctgg

SEQ ID NO: 1117 - DNA, 60 bp, Homo sapiens; identical to SEQ ID NO: 661

SEQ ID NO: 1118 - DNA, 60 bp, Homo sapiens
cggaagaagagataagatactgcgaataggccctcaaacttaaaaaagaaaaaactttgc

SEQ ID NO: 1119 - DNA, 60 bp, Homo sapiens
ttttttcatttgtcaaaatgcttcttttgttgccacagtaaagaacagtttttattgttt

SEQ ID NO: 1120 - DNA, 60 bp, Homo sapiens; identical to SEQ ID NO: 662

SEQ ID NO: 1121 - DNA, 60 bp, Homo sapiens
ggctttataacagatgactgtcaagtgaatgagctgttgatatcctgtcagtttagtcaa

SEQ ID NO: 1122 - DNA, 60 bp, Homo sapiens
tggatacttttagcaaataggaacttaattctcagcactgaacatgaattacttccttgg

SEQ ID NO: 1123 - DNA, 60 bp, Homo sapiens
ggaggcatttactaaccagttaccagctggcttaataaccacagacggtcaacaacaaaa

SEQ ID NO: 1124 - DNA, 60 bp, Homo sapiens; identical to SEQ ID NO: 666

SEQ ID NO: 1125 - DNA, 60 bp, Homo sapiens
cttctctggcatggttttgctgaatttctgatttttctcttaccacttatcaatgtccag

SEQ ID NO: 1126 - DNA, 60 bp, Homo sapiens
gctaatttttaaaaggcctgaactatactttgaagaaacccctatagaaaaggaaagctc

SEQ ID NO: 1127 - DNA, 60 bp, Homo sapiens
aacgtgctcactgtgtataggaatttgtattttggaggtgcttgatctatctacaaagaa

SEQ ID NO: 1128 - DNA, 60 bp, Homo sapiens; identical to SEQ ID NO: 667

SEQ ID NO: 1129 - DNA, 60 bp, Homo sapiens
catgccataaaatactatgctttattggtcccatgttttgtgcaattttaaagagatggc

SEQ ID NO: 1130 - DNA, 60 bp, Homo sapiens
ttatgatttcttaatgtaaaatgttttgttgaagtatatggctatcatgactaagtgcta

SEQ ID NO: 1131 - DNA, 60 bp, Homo sapiens; identical to SEQ ID NO: 671

SEQ ID NO: 1132 - DNA, 60 bp, Homo sapiens
tacaaaggtcagcaaattggcaaagtagtccaggtttacaggaagaaatatgttatctac

SEQ ID NO: 1133 - DNA, 60 bp, Homo sapiens
attgaaatcttgaatgtattgaatctgtcaaggtacacagcggtgcctttgtaaatgttc

SEQ ID NO: 1134 - DNA, 60 bp, Homo sapiens; identical to SEQ ID NO: 672

SEQ ID NO: 1135 - DNA, 60 bp, Homo sapiens
attcatttcacagtcttctattgttggaccacttacattgtaccaaatgttttcctttgg

SEQ ID NO: 1136 - DNA, 60 bp, Homo sapiens
ctagaaggggaaaaatcatctaagttatgaaatccaacataggcgctatattacaaactg

SEQ ID NO: 1137 - DNA, 60 bp, Homo sapiens
gaccacctcaaatttaaaggctaccttattgtacgtttaaagtgtattataacagtgtgg

SEQ ID NO: 1138 - DNA, 60 bp, Homo sapiens
gtgaaatggttaaacttctgcactttcttagttaccacagtcttcataccaagtattggg

SEQ ID NO: 1139 - DNA, 60 bp, Homo sapiens
gcttacatttgtggatcactacatagccagattcaaaaatattttacttgttccatccac

SEQ ID NO: 1140 - DNA, 60 bp, Homo sapiens
tgtctctcactacctattacacactgttgctttgtgggtttgttttgtatgtgcgtgtgt

SEQ ID NO: 1141 - DNA, 60 bp, Homo sapiens
acctaagagttaccacttccgtagcctataacatcaaaacgtagtttttgcatgttttca

SEQ ID NO: 1142 - DNA, 60 bp, Homo sapiens; identical to SEQ ID NO: 679

SEQ ID NO: 1143 - DNA, 60 bp, Homo sapiens; identical to SEQ ID NO: 680

SEQ ID NO: 1144 - DNA, 60 bp, Homo sapiens
ttttacctgcttagacttttatgtgacttgtatggtctcctggttaaagggaatggtgtc

SEQ ID NO: 1145 - DNA, 60 bp, Homo sapiens
gcactgcttttaattactgctgtatatttgttgattttggagttacaactgtggtgatag

SEQ ID NO: 1146 - DNA, 60 bp, Homo sapiens
atcctttcaaaccctcatgactgacaaaaactccatggggccaaatctgcctgaagatca

SEQ ID NO: 1147 - DNA, 60 bp, Homo sapiens
atgaccctgtatgtaaagcagaaaacttcaaatctgactgtttcccattacctgctgaag

SEQ ID NO: 1148 - DNA, 60 bp, Homo sapiens
agcagacagtgtttgtattttcaactggagtacatgtattttctttgtaaagtagcttcc

SEQ ID NO: 1149 - DNA, 60 bp, Homo sapiens
gggcttcagtttcaacatctgtaaaatgggcatgttaacattgcctacctcataggatta

SEQ ID NO: 1150 - DNA, 60 bp, Homo sapiens; identical to SEQ ID NO: 682

SEQ ID NO: 1151 - DNA, 60 bp, Homo sapiens
gagcaagataaagacaaaccgaagactctttgaagacatcgtaacactgaaaagtacact

SEQ ID NO: 1152 - DNA, 60 bp, Homo sapiens; identical to SEQ ID NO: 683

SEQ ID NO: 1153 - DNA, 60 bp, Homo sapiens
cttgaacctgactgatagctgttttaagagccactggcctgtaattgtttgatatatttg

SEQ ID NO: 1154 - DNA, 60 bp, Homo sapiens
tctcgccaaaatgaagtttaatccctttgtgacttccgaccgaagcaagaatcgcaaaag

SEQ ID NO: 1155 - DNA, 60 bp, Homo sapiens
tagctcagtatcatctcccttcatgtaagcagcacgttttaactcttaggaagctgaatg

SEQ ID NO: 1156 - DNA, 60 bp, Homo sapiens
ccaccagatacagaaatgtgctttaacatcagttgaaacctaaattttcttatgttgtgg

SEQ ID NO: 1157 - DNA, 60 bp, Homo sapiens
ttgttcaggcttattatggctcatagattacagagaatgatgctagttacatgccaatga

SEQ ID NO: 1158 - DNA, 60 bp, Homo sapiens
gatttatttcttctaatcaaagatgcataacagctattatctaggggaccaccaaatgtg

SEQ ID NO: 1159 - DNA, 60 bp, Homo sapiens
atcttgcaggtctagtattttaataatgcactattacccagggcagatattatgagaaac

SEQ ID NO: 1160 - DNA, 60 bp, Homo sapiens
ggttcagtaacttttcattttataacattgggcacggtacagagtgattgtcacataagg

SEQ ID NO: 1161 - DNA, 60 bp, Homo sapiens
gatcctcgtcttacagcgaatggtttcaagataaaattgataccaggagtttcaattact

SEQ ID NO: 1162 - DNA, 60 bp, Homo sapiens
gagaatggaagatcagggtcagagtattattccaatgcttactggagaagtgattcctgt

SEQ ID NO: 1163 - DNA, 60 bp, Homo sapiens
ccattaacctacacactgatttttatgctactccttgtagaaacaaaattctggtttgac

SEQ ID NO: 1164 - DNA, 60 bp, Homo sapiens; identical to SEQ ID NO: 689

SEQ ID NO: 1165 - DNA, 60 bp, Homo sapiens
gcatggatgcttctctgtctcatcagtccttagtagcactatcagagaaactggcaagat

SEQ ID NO: 1166 - DNA, 60 bp, Homo sapiens
tgtcgcttaatgcctatgcactggatttctacaaacatggttccttgataggattagtcc

SEQ ID NO: 1167 - DNA, 60 bp, Homo sapiens
taaggctgttagtcttgaagattgaaaattactgaaaactgaatctttattacgtgtcct

SEQ ID NO: 1168 - DNA, 60 bp, Homo sapiens; identical to SEQ ID NO: 692

SEQ ID NO: 1169 - DNA, 60 bp, Homo sapiens
tggcttggagcagattcgacttcataaacaaattgttcctgaaaatgaggcacaggtcat

SEQ ID NO: 1170 - DNA, 60 bp, Homo sapiens
cataagagaaacctgcatacattttgatattaagaaataattccggggattcttccactc

SEQ ID NO: 1171 - DNA, 60 bp, Homo sapiens
aaatttatggaatcagctctcgcactgcccatctttgcagttttgaaaaagaaattgctt

SEQ ID NO: 1172 - DNA, 60 bp, Homo sapiens; identical to SEQ ID NO: 694

SEQ ID NO: 1173 - DNA, 60 bp, Homo sapiens
aaacctaccgtcagtctgaaaaaacttgaagtacattcaaatgatccagatatgtctgtt

SEQ ID NO: 1174 - DNA, 60 bp, Homo sapiens; identical to SEQ ID NO: 697

SEQ ID NO: 1175 - DNA, 60 bp, Homo sapiens; identical to SEQ ID NO: 698

SEQ ID NO: 1176 - DNA, 60 bp, Homo sapiens
aagtacaggattttcttcaggtaaaatctgtgtgttccaattacagttgtagctgaagga

SEQ ID NO: 1177 - DNA, 60 bp, Homo sapiens; identical to SEQ ID NO: 701

SEQ ID NO: 1178 - DNA, 60 bp, Homo sapiens; identical to SEQ ID NO: 702

SEQ ID NO: 1179 - DNA, 60 bp, Homo sapiens
aacattttacttctgcgcttctatgtttgggaaacattgctctgataaaaaatagctgtc

SEQ ID NO: 1180 - DNA, 60 bp, Homo sapiens
ggtctgaaaaagcagggaataccattattttcggattagcggttattaagctcttctata

SEQ ID NO: 1181 - DNA, 60 bp, Homo sapiens; identical to SEQ ID NO: 703

SEQ ID NO: 1182 - DNA, 60 bp, Homo sapiens
atggagtaaaacaactgctacagttcagcacctgttttatgtgccgaatcactgtgggga

SEQ ID NO: 1183 - DNA, 60 bp, Homo sapiens
aaccaggtgggaccaaagtttatgtgcctttagtcttaatttaccttgcattgtaatatt

SEQ ID NO: 1184 - DNA, 60 bp, Homo sapiens
tggagcagaccatagctgaagctgttattttcagtcaggaagactacctgtcatgaaggt

SEQ ID NO: 1185 - DNA, 60 bp, Homo sapiens; identical to SEQ ID NO: 704

SEQ ID NO: 1186 - DNA, 60 bp, Homo sapiens
gaatattaagtgctacttgaggtacatgttcagactaacattcttttgcagtatagtgag

SEQ ID NO: 1187 - DNA, 60 bp, Homo sapiens
cctcacaagtgtgatgattgtgggcaagctttacttcatgttcacaccgtcttagacatc

SEQ ID NO: 1188 - DNA, 60 bp, Homo sapiens
gtttccacatcttgctgaagcccaaaagtcaagtcttgtctaagatgtctgaactattaa

SEQ ID NO: 1189 - DNA, 60 bp, Homo sapiens
gtaacagtttactggttgttccattcctgaatatgcaggctaatttgtacagatagggat

SEQ ID NO: 1190 - DNA, 60 bp, Homo sapiens
ctggcagttctatagtagtccagactttagaaaccaaacacaacaaaatggcttgttgcc

SEQ ID NO: 1191 - DNA, 60 bp, Homo sapiens
aaagagtgattaagtgaggttatttacccctaaatggtccattctgcattgtatttcagg

SEQ ID NO: 1192 - DNA, 60 bp, Homo sapiens; identical to SEQ ID NO: 707

SEQ ID NO: 1193 - DNA, 60 bp, Homo sapiens
cccttgttataagttttatgtcaagtaaggtagtttgtttaagttagttacccatgtccc

SEQ ID NO: 1194 - DNA, 60 bp, Homo sapiens; identical to SEQ ID NO: 708

SEQ ID NO: 1195 - DNA, 60 bp, Homo sapiens
tgggctcatattgtgcataccattttgtaacctgcttttttcacttaacaatatattggg

SEQ ID NO: 1196 - DNA, 60 bp, Homo sapiens
ttatacttcccagctattccatctgtggatgaaagtaacaatgttggccacgtatatttt

SEQ ID NO: 1197 - DNA, 60 bp, Homo sapiens
atgtattcttggctgctatgcgtggtttttcaggaaatttaattatcttactgagatgtg

SEQ ID NO: 1198 - DNA, 60 bp, Homo sapiens
gtccacccaagtaagaagtgtatctgcctttccatcttttggttttcatttgggcatgtg

SEQ ID NO: 1199 - DNA, 60 bp, Homo sapiens
ccttttgtccaccatggatatatctgactgctttattgatggtaatgaaaatggagacct

SEQ ID NO: 1200 - DNA, 60 bp, Homo sapiens
gatatccgtgttcataccacttttcttatgtgaataggttctttaacttctaacaaaggc

SEQ ID NO: 1201 - DNA, 60 bp, Homo sapiens
aaggtttcatgtgattcatgtgtaagatgcacagtatttgacatcctgattatgtaatcc

SEQ ID NO: 1202 - DNA, 60 bp, Homo sapiens
atctatatttgttattactcagtgactctctaatttcacatcagcatgttcagcttgtgc

SEQ ID NO: 1203 - DNA, 60 bp, Homo sapiens
atgatcagtgcggttatgtggaaacaacaacaaacaaacgaagctatctgagtgaactgc

SEQ ID NO: 1204 - DNA, 60 bp, Homo sapiens
tttggcagtgagcagttgaatttatcttgaatttatcatgtgtgtgtatttctgaagcag

SEQ ID NO: 1205 - DNA, 60 bp, Homo sapiens; identical to SEQ ID NO: 713

SEQ ID NO: 1206 - DNA, 60 bp, Homo sapiens
aaaccaaagctcatcgaagaatacatccttgagagagatgtaataaatgtaatggatgtg

SEQ ID NO: 1207 - DNA, 60 bp, Homo sapiens
gaaaggcatgcagtttgtccattgtgacagtttgtttaataaaaccacatacacacttta

SEQ ID NO: 1208 - DNA, 60 bp, Homo sapiens
caaagatgcatttacctctgtatcaactcaggaaatctcataagctggtaccactcagga

SEQ ID NO: 1209 - DNA, 60 bp, Homo sapiens
atgaatgtctgagatacgtctgtgacttatctaccattgaaggaaagctatatctatttg

SEQ ID NO: 1210 - DNA, 60 bp, Homo sapiens
tcccaactagatggcctagagtccaacattaccttttgagatgacattattgtctccata

SEQ ID NO: 1211 - DNA, 60 bp, Homo sapiens
agaatctggaaaccatacaagaaacgtgagactcctgattgcttctggaaatactgtgtc

SEQ ID NO: 1212 - DNA, 60 bp, Homo sapiens; identical to SEQ ID NO: 715

SEQ ID NO: 1213 - DNA, 60 bp, Homo sapiens
tcaaagattcagagattggcttttgtcatccactattgtatgttttgtttcattgacctc

SEQ ID NO: 1214 - DNA, 60 bp, Homo sapiens; identical to SEQ ID NO: 716

SEQ ID NO: 1215 - DNA, 60 bp, Homo sapiens; identical to SEQ ID NO: 718

SEQ ID NO: 1216 - DNA, 60 bp, Homo sapiens
tcctgcattgccatctacataatatcagatattacggatgttagattgcatctcagtgtt

SEQ ID NO: 1217 - DNA, 60 bp, Homo sapiens
tgtgatgaatgtggtaaagccttcagctataggtcatacctcactacacatcggagaagt

SEQ ID NO: 1218 - DNA, 60 bp, Homo sapiens
aatgaataatgaccttatgaagtatgctatctgtaggctgaaattataggtacatctgtt

SEQ ID NO: 1219 - DNA, 60 bp, Homo sapiens
ctattggcgaggttccaatatcatttgtggatcgtgtttatggtgaatccaagttgggag

SEQ ID NO: 1220 - DNA, 60 bp, Homo sapiens
ggctccattgattttattaagccttcctttaccttgtagtacaaggtgctttaatgggat

SEQ ID NO: 1221 - DNA, 60 bp, Homo sapiens; identical to SEQ ID NO: 720

SEQ ID NO: 1222 - DNA, 60 bp, Homo sapiens
gcaacagacagaagtactttgtagagattgacttcctaagctacttaagacaacttgcac

SEQ ID NO: 1223 - DNA, 60 bp, Homo sapiens
tgtttttgggtgtctccttcttgtgcccatatctgataagctttatggattattgcattt

SEQ ID NO: 1224 - DNA, 60 bp, Homo sapiens
caatggcttacagtttctgtctggtcatctggaacttgaaaaatcctcaaatgccttcac

SEQ ID NO: 1225 - DNA, 60 bp, Homo sapiens
ggtctcttgttgaaatccgaaatttcttgggtgaaaaatatatccgcagggttcggatga

SEQ ID NO: 1226 - DNA, 60 bp, Homo sapiens
gcattatgtgtatggcctgaagtgttggacttgcaaaaggggaagaaaggaattgcgaat

SEQ ID NO: 1227 - DNA, 60 bp, Homo sapiens
catgagccctactgcctaaacactatttcatttatttatgtttggaaaccccgtaaacat

SEQ ID NO: 1228 - DNA, 60 bp, Homo sapiens
gataaaagttcttccagtcagtttttctcttaagtgcctgtttgagtttactgaaacagt

SEQ ID NO: 1229 - DNA, 60 bp, Homo sapiens
tttttgatatttaacaatgcttaacactttaaatgccacttctgaggaatggacctggtg

SEQ ID NO: 1230 - DNA, 60 bp, Homo sapiens
aacctcagtaatgagcctaaatttactctgcttggctctctacacatggcatttcagggt

SEQ ID NO: 1231 - DNA, 60 bp, Homo sapiens
ttcaagtagctttctctgggggaaaaagtaccacttggacacttaaaggaattgggattt

SEQ ID NO: 1232 - DNA, 60 bp, Homo sapiens
ccagaacaaattttaacaaaaggacaaccacagagggatatagtgaatatcgtatcattg

SEQ ID NO: 1233 - DNA, 60 bp, Homo sapiens
tgtttctttatgctgctggcttttgtgccctggaagatcataatagtgaccaaaatatac

SEQ ID NO: 1234 - DNA, 60 bp, Homo sapiens
tatgtggagatgatttttcacctttaaactctaagccaagtgtaagaaactcttgatagc

SEQ ID NO: 1235 - DNA, 60 bp, Homo sapiens
tgaaggctttttacccagcaatgtcctcaatgagggtcttttctttccctcaccaaaacc

SEQ ID NO: 1236 - DNA, 60 bp, Homo sapiens; identical to SEQ ID NO: 724

SEQ ID NO: 1237 - DNA, 60 bp, Homo sapiens
tctgcctcagcattatctaaatgatcttgatagtgctctgatacctgtgatccatggtgg

SEQ ID NO: 1238 - DNA, 60 bp, Homo sapiens
tattgtgtttactacttgtgatcatgtagttgtgccttactttgtgagaaaggttagctc

SEQ ID NO: 1239 - DNA, 60 bp, Homo sapiens; identical to SEQ ID NO: 726

SEQ ID NO: 1240 - DNA, 60 bp, Homo sapiens
aaagtacttgagaccaaggccagcatcaattccagacatcttcatgttcctaataggcta

SEQ ID NO: 1241 - DNA, 60 bp, Homo sapiens; identical to SEQ ID NO: 727

SEQ ID NO: 1242 - DNA, 60 bp, Homo sapiens
atttctgtaatgtccccttctttctaggctctgttgctgtgtgaatccattagatttaca

SEQ ID NO: 1243 - DNA, 60 bp, Homo sapiens
actggagaaccaagaacgcacttgaaatttttctaagctccttaattgaaatgctgtggt

SEQ ID NO: 1244 - DNA, 60 bp, Homo sapiens; identical to SEQ ID NO: 730

SEQ ID NO: 1245 - DNA, 60 bp, Homo sapiens; identical to SEQ ID NO: 731

SEQ ID NO: 1246 - DNA, 60 bp, Homo sapiens; identical to SEQ ID NO: 732

SEQ ID NO: 1247 - DNA, 60 bp, Homo sapiens
tgctagtttgcatatgttttcctatgcaatagttgttttcccagttattcaaagcagctt

SEQ ID NO: 1248 - DNA, 60 bp, Homo sapiens
tctgtttcgttaatgtcagctgcctgaacattcagcagtttataaattgcttaatttgtg

SEQ ID NO: 1249 - DNA, 60 bp, Homo sapiens
gataccaacagaaatatcaacttctggagtctattaaatgtgttgtcacctttctaaagc

SEQ ID NO: 1250 - DNA, 60 bp, Homo sapiens; identical to SEQ ID NO: 738

SEQ ID NO: 1251 - DNA, 60 bp, Homo sapiens; identical to SEQ ID NO: 739

SEQ ID NO: 1252 - DNA, 60 bp, Homo sapiens
tgatttgctagaaggggatacagaatgccatgctagatttaagactcctgaggatgctca

SEQ ID NO: 1253 - DNA, 60 bp, Homo sapiens; identical to SEQ ID NO: 742

SEQ ID NO: 1254 - DNA, 60 bp, Homo sapiens
gtaagaaatatcgtcagtcgtcctaatgcatattgtgactgtttgcatatacttctgttt

SEQ ID NO: 1255 - DNA, 60 bp, Homo sapiens
tgtgcaatatgtgatgtggcaaatctctattaggaaatattctgtaatcttcagacctag

SEQ ID NO: 1256 - DNA, 60 bp, Homo sapiens
gtataatgaatgtagcagagcctttagtttttgttcaaggcttaataaccgttagctaga

SEQ ID NO: 1257 - DNA, 60 bp, Homo sapiens
tgtgaccgtgatatagtgagaaagattctaccaaccactgtttcactactttttagttaa

SEQ ID NO: 1258 - DNA, 60 bp, Homo sapiens
agtgcatcattttactacatgatcttccaattagatagcttgtaatctgttccttacagc

SEQ ID NO: 1259 - DNA, 60 bp, Homo sapiens
ttcattttctcaaagggcataccttgtgcattgtggcttatgatgagccatattaattgc

SEQ ID NO: 1260 - DNA, 60 bp, Homo sapiens
gggcttaggagtgagatttctggtctacagaaatgatcatgctcatgaattttgacattt

SEQ ID NO: 1261 - DNA, 60 bp, Homo sapiens
tgcaccaagtctcactggctgtcagtatgacatttcacgggagatttcttgttgctcaaa

SEQ ID NO: 1262 - DNA, 60 bp, Homo sapiens
tgtacctgaaaaatgggaagagtcgggaccacagtttattaccaattctgaggaagtccg

SEQ ID NO: 1263 - DNA, 60 bp, Homo sapiens; identical to SEQ ID NO: 743

SEQ ID NO: 1264 - DNA, 60 bp, Homo sapiens
ggaatcttttagtaaaatagcagtgttttttgttgtttttgcattggatttggggagtgg

SEQ ID NO: 1265 - DNA, 60 bp, Homo sapiens; identical to SEQ ID NO: 744

SEQ ID NO: 1266 - DNA, 60 bp, Homo sapiens
ggctctttgtggaggaaactaaacattcccttgatggtctcaagctatgatcagaagact

SEQ ID NO: 1267 - DNA, 60 bp, Homo sapiens
taccagggtggcagaaaagggaaaagaaactctgaatccgaccagtgtaggtgattacat

SEQ ID NO: 1268 - DNA, 60 bp, Homo sapiens; identical to SEQ ID NO: 747

SEQ ID NO: 1269 - DNA, 60 bp, Homo sapiens
tccttgcagagaaagcttgtgcccaaacatggtgatagattttttactatttagaataag

SEQ ID NO: 1270 - DNA, 60 bp, Homo sapiens
taatagttaactgactatagattgttttctatgccatgtatgtgccacttctgagagtag

SEQ ID NO: 1271 - DNA, 60 bp, Homo sapiens; identical to SEQ ID NO: 748

SEQ ID NO: 1272 - DNA, 60 bp, Homo sapiens
tgtgaacaccaggactttaatcttatgcttaaaatgccagatgttgttcgggggacaact

SEQ ID NO: 1273 - DNA, 60 bp, Homo sapiens
gctgggtattaccatgtaaataatctgtgagtgaaagttgccattattctatgtagtggt

SEQ ID NO: 1274 - DNA, 60 bp, Homo sapiens
tattagagtctaaaaaaccctagagttactctcttttgggaacataaggaggtatacaga

SEQ ID NO: 1275 - DNA, 60 bp, Homo sapiens
ctttttgtactgttgaaaccacttcattggacatgttgcaatagcaaaacccccagttag

SEQ ID NO: 1276 - DNA, 60 bp, Homo sapiens
ggattctttccatttgcatttgtttatgtaatttcaggaggaatactgaacatctgagtc

SEQ ID NO: 1277 - DNA, 60 bp, Homo sapiens
tgggccagcttttcaaacaaagatgccacattcaaaatagggtatattttcctatattac

SEQ ID NO: 1278 - DNA, 60 bp, Homo sapiens
taaaaggttctgttttgtttggaatcaatggtagctttattgactgttctgattgtgctg

SEQ ID NO: 1279 - DNA, 60 bp, Homo sapiens; identical to SEQ ID NO: 752

SEQ ID NO: 1280 - DNA, 60 bp, Homo sapiens
ctgtgctctaggaaatgcaccaataccaaaggtcaatgtggaaatatgggcatgtttgcc

SEQ ID NO: 1281 - DNA, 60 bp, Homo sapiens
tggcaaggtagtccaggtgtacagaaagaaatatgtcatctacatcgagcgggtgcagcg

SEQ ID NO: 1282 - DNA, 60 bp, Homo sapiens
tattagtgtgggactgtgactgaggtcttaaagactgaaagagttggggttcattttctg

SEQ ID NO: 1283 - DNA, 60 bp, Homo sapiens; identical to SEQ ID NO: 753

SEQ ID NO: 1284 - DNA, 60 bp, Homo sapiens; identical to SEQ ID NO: 756

SEQ ID NO: 1285 - DNA, 60 bp, Homo sapiens; identical to SEQ ID NO: 758

SEQ ID NO: 1286 - DNA, 60 bp, Homo sapiens
tttctgagaccacgtataccagtgaaaattagcttctgagtaaatttctaatttatgccc

SEQ ID NO: 1287 - DNA, 60 bp, Homo sapiens
cgcacactgaaaaacacagatatcaaagttgttgactttggaagtgcaacgtatgatgat

SEQ ID NO: 1288 - DNA, 60 bp, Homo sapiens
gctacaacttcttgaacttcaagttaaggctagacatttactttgaaaaaattccactgg

SEQ ID NO: 1289 - DNA, 60 bp, Homo sapiens; identical to SEQ ID NO: 762

SEQ ID NO: 1290 - DNA, 60 bp, Homo sapiens; identical to SEQ ID NO: 763

SEQ ID NO: 1291 - DNA, 60 bp, Homo sapiens
aactgaaatctttccagaaaatccaagtccagctagtagaattggagaaaaagttcagtg

SEQ ID NO: 1292 - DNA, 60 bp, Homo sapiens
tcgaagcaagtaccacaaaaggcatttcaatgcactttcccacattctcagaaatattag

SEQ ID NO: 1293 - DNA, 60 bp, Homo sapiens
caggtcagaagaatgatggaatgttttagaataaactcctgcttatagtatactacacag

SEQ ID NO: 1294 - DNA, 60 bp, Homo sapiens
taaaaacctcacattctacttgatttacacttcctagtctacattacatgtggttgaagg

SEQ ID NO: 1295 - DNA, 60 bp, Homo sapiens
tttggaatggagtatatgcctgaaaaggttttggattcagaaagaaaaaggatggttagt

SEQ ID NO: 1296 - DNA, 60 bp, Homo sapiens
tgagtaacttattttgtatcaggaatgttttggtactgtgttttcactcaaaccactgac

SEQ ID NO: 1297 - DNA, 60 bp, Homo sapiens
gatggcaagaaaagctggcaactactttgtacctgcagaacccaaactggcatttgtcat

SEQ ID NO: 1298 - DNA, 60 bp, Homo sapiens
taacagcatagctgtccctgtgggcattcacccaaaggtggttatcactagactaaaact

SEQ ID NO: 1299 - DNA, 60 bp, Homo sapiens
caatatacagcaaggtgattatttcaagagaatcccaaagtacttgaataagggctattg

SEQ ID NO: 1300 - DNA, 60 bp, Homo sapiens
gtgcgttgagcccaaaagatctaagagaatgctggctaaaagatgcaagcattttgaact

SEQ ID NO: 1301 - DNA, 60 bp, Homo sapiens
tgtcgatgtcaagactaatgatggctacttctttaatctgttctgtgttggttttactga

SEQ ID NO: 1302 - DNA, 60 bp, Homo sapiens
aaagttgagttatatacttgtacatacaatggaaatgcttttagtagtgattatttagca

SEQ ID NO: 1303 - DNA, 60 bp, Homo sapiens
tgtctcataccgaatccgtgtgcgattatccagaaaggatgaagattcaccaaataagct

SEQ ID NO: 1304 - DNA, 60 bp, Homo sapiens
gaagcttaacaaggtttcaattaacatgctggggattgtagaaccatatattgcagggta

SEQ ID NO: 1305 - DNA, 60 bp, Homo sapiens
ccttgtgccatatacacacaaaattttgtggaaggcagttttaactttctgaagaatatc

SEQ ID NO: 1306 - DNA, 60 bp, Homo sapiens
tccaagtctggctagtacgtgaattggagaaaaagtttgggaagcatgttgtctttattg

SEQ ID NO: 1307 - DNA, 60 bp, Homo sapiens
ctatactgttggaaaacacttcaaagaaaataacttcctgcggccattcaaattatcttc

SEQ ID NO: 1308 - DNA, 60 bp, Homo sapiens
aagattgaatggctaggagtaattctgttctcgtataggcaacttaacttcactgtggaa

SEQ ID NO: 1309 - DNA, 60 bp, Homo sapiens
aaagaaagccatacatagaatgcttcaagctatcttgctatgcacattatacttgtactg

SEQ ID NO: 1310 - DNA, 60 bp, Homo sapiens
aactgaaatctttccagaaaatccaaatccggctagtaagtgaattggagaaaaagttca

SEQ ID NO: 1311 - DNA, 60 bp, Homo sapiens
tccatgctattgttgtgtcagagggagtacctgttattaaagtggccattgataatgctc

SEQ ID NO: 1312 - DNA, 60 bp, Homo sapiens
gattccacagattcaaaaagtgtgtgaagttgtagatgggttcatctatgttgcaaatgc

SEQ ID NO: 1313 - DNA, 60 bp, Homo sapiens
tgccccttaaaagattgaagaaagagaaacttgtcaactcatatccacgttatctagcaa

SEQ ID NO: 1314 - DNA, 60 bp, Homo sapiens
ttgcacaagaggctggtctgaatatgattgttcacattaagagtgtttattcgtcggttc

SEQ ID NO: 1315 - DNA, 60 bp, Homo sapiens
agattgaggttaacttagagttgggagttgatttattaagtacagtatacctctcaacag

SEQ ID NO: 1316 - DNA, 60 bp, Homo sapiens; identical to SEQ ID NO: 771

SEQ ID NO: 1317 - DNA, 60 bp, Homo sapiens; identical to SEQ ID NO: 772

SEQ ID NO: 1318 - DNA, 60 bp, Homo sapiens
gaacagagaccagaaagagtaaaaccttttatgacaggggctgcagaacaaatcaagcac

SEQ ID NO: 1319 - DNA, 60 bp, Homo sapiens; identical to SEQ ID NO: 776

SEQ ID NO: 1320 - DNA, 60 bp, Homo sapiens
tcagccttatcccttggcacgtaaacagactactagacttattgtaggttcgtttgagct

SEQ ID NO: 1321 - DNA, 60 bp, Homo sapiens
aggaaccctgcggagggacttcaatcacatcgtagaactcagtcttcttggaaagaaaaa

SEQ ID NO: 1322 - DNA, 60 bp, Homo sapiens
aagtttccttaactatcttatgtttctagtctttcaagcttagtgataaggtggaagcac

SEQ ID NO: 1323 - DNA, 60 bp, Homo sapiens
aaggacttaggagtatatgggaggttattggttttatgtttaaggatacgtttacttgag

SEQ ID NO: 1324 - DNA, 60 bp, Homo sapiens
tataggaaggtgttctttaggtatgttacaggattactttaaaccatttgactttcgctc

SEQ ID NO: 1325 - DNA, 60 bp, Homo sapiens
atttaaattaaccctctcagttaattgtcccctgtaaacgatgtgtgcagtgtaaattgt

SEQ ID NO: 1326 - DNA, 60 bp, Homo sapiens
aaactgcttagattttgttgatgacattagattagtagttgcattaaataactaaattcc

SEQ ID NO: 1327 - DNA, 60 bp, Homo sapiens; identical to SEQ ID NO: 781

SEQ ID NO: 1328 - DNA, 60 bp, Homo sapiens
gaggggttcgtgctgtaagacttaaagttcttatgaaattgtccaaaacaaacaaacatg

SEQ ID NO: 1329 - DNA, 60 bp, Homo sapiens
tttagaggggggtagaatttagtaaatattccagccggtcgttttatgcacaaggcttca

SEQ ID NO: 1330 - DNA, 60 bp, Homo sapiens
ctggaaaatgttcatatatatgtatatgaatgtctctttatgctgaagggctctgattgg

SEQ ID NO: 1331 - DNA, 60 bp, Homo sapiens
acagaagtacaacgtgcgatccatgatccgaaagaatgatgaagttaggcttgtaccagg

SEQ ID NO: 1332 - DNA, 60 bp, Homo sapiens
aaatgtgttccatgatcaaaaaatggcagacaatgattcttcatctgttctgtgttggtt

SEQ ID NO: 1333 - DNA, 60 bp, Homo sapiens
ctttggttacctatgtacctgttaccactttcaaaaatctacagacagtcaatgtggatg

SEQ ID NO: 1334 - DNA, 60 bp, Homo sapiens
tactttggttacccatgtacctaccactttcaaaaatctacagagagtcaatgtggagga

SEQ ID NO: 1335 - DNA, 60 bp, Homo sapiens
cagaaatgtcaatgagactaaagtggttttgtaaatctcagctatatttagcaacactcc

SEQ ID NO: 1336 - DNA, 60 bp, Homo sapiens
gttgaaaatggtttcaagttattcaaatttgtacaggactgtaaagatttgttgacagca

SEQ ID NO: 1337 - DNA, 60 bp, Homo sapiens
tcatcttactgtgcaatcaaaattagagtactttggtttgaaaacaacacttagagcctc

SEQ ID NO: 1338 - DNA, 60 bp, Homo sapiens
gactattttcttagtgaatatttatactaaggtagtgactgagatttggtgatctggctg

SEQ ID NO: 1339 - DNA, 60 bp, Homo sapiens
aagaagctccacaacaagacagcaggttatgtcacccatctgatgaagcagattcagaga

SEQ ID NO: 1340 - DNA, 60 bp, Homo sapiens
gaaccctgcggagggacttcaatcacatcaatgtagaactcagccttcttggaaagaaaa

SEQ ID NO: 1341 - DNA, 60 bp, Homo sapiens
gggttttttggattgtacagtgtttatatgatctgaactccttatacataagaaggtgtg

SEQ ID NO: 1342 - DNA, 60 bp, Homo sapiens
ccaaagagccatgtgtcatgtaatactgaaccactttgatattgagacattaatttgtac

SEQ ID NO: 1343 - DNA, 60 bp, Homo sapiens
atagactatgtacttgtctggtttttgtttgtttttattttggaatgcttataagcctcc

SEQ ID NO: 1344 - DNA, 60 bp, Homo sapiens
gactttttgaaagtctaccttctaaattgccccgacgatctagattctacatgttaccat

SEQ ID NO: 1345 - DNA, 60 bp, Homo sapiens
atttgacatttgtgtgtaatttcatggtggcctagtgttgtggtgcttctggtaatggta

SEQ ID NO: 1346 - DNA, 60 bp, Homo sapiens
tgagatatttaaggttgaatgtttgtccttaggataggcctatgtgctagcccacaaaga

SEQ ID NO: 1347 - DNA, 60 bp, Homo sapiens
agcactatttaaatcagtgtctgtaactcagttttggataaatgcaaagacaagttaccc

SEQ ID NO: 1348 - DNA, 60 bp, Homo sapiens
tggactactggaaggatggtgtgactccatatgtgattttctttgaggatgatttagaaa

SEQ ID NO: 1349 - DNA, 60 bp, Homo sapiens
tatgcaagtctgtgaattttttgcacagtaataagttgactcacacagacttaaagcctg

SEQ ID NO: 1350 - DNA, 60 bp, Homo sapiens; identical to SEQ ID NO: 791

SEQ ID NO: 1351 - DNA, 60 bp, Homo sapiens
ttgtgtgtgttggggggtacttttaaaggtgactattgttttgtacatctaattttggga

SEQ ID NO: 1352 - DNA, 60 bp, Homo sapiens
tgcagaggatcatactttgagtgaacaggattccatacaaaaaagtcctttatcagaaac

SEQ ID NO: 1353 - DNA, 60 bp, Homo sapiens
cccagaatctaatgtagttcgctattaataacaatgcattattgaaagtatattgcaaat

SEQ ID NO: 1354 - DNA, 60 bp, Homo sapiens
ccttcattttcctgtatattctctgtactatgtcgattcgacagaacattcagaagattc

SEQ ID NO: 1355 - DNA, 60 bp, Homo sapiens
ctatgaaaggaagctcaactccagtaaagaactaagaacagtgtataacatgaagataac

SEQ ID NO: 1356 - DNA, 60 bp, Homo sapiens; identical to SEQ ID NO: 792

SEQ ID NO: 1357 - DNA, 60 bp, Homo sapiens
agcactctgagagctgggatagcttcctgaaatacatgaaggaaaatgatcagaaaaaga

SEQ ID NO: 1358 - DNA, 60 bp, Homo sapiens
agtgggaattttgaaatgccatgtcctatatattctggcatatttgttggcacatttgca

SEQ ID NO: 1359 - DNA, 60 bp, Homo sapiens
gtgtatgtattctgccatgtaagtaattgaacagtcttaaaataaccaaatggtagaggg

SEQ ID NO: 1360 - DNA, 60 bp, Homo sapiens
cccatacttacttcacttgttatacatcactgattatttgggttaaactggactcatttc

SEQ ID NO: 1361 - DNA, 60 bp, Homo sapiens
ctttctggataccttaattgtaactgtcagtttgcactggtcggtatatggaaacacatt

SEQ ID NO: 1362 - DNA, 60 bp, Homo sapiens
ccaattcattcaacatagaacaagccaattataccatccagtcattgaaggacaccaaga

SEQ ID NO: 1363 - DNA, 60 bp, Homo sapiens
gtttattttctatgtgagtcacattgacatgcgatcagtttgggaaatgtgatgaaaaca

SEQ ID NO: 1364 - DNA, 60 bp, Homo sapiens
atccttgaaggaaatgacattgagcttgtttcaattcagcaagccacaacagttaaaaac

SEQ ID NO: 1365 - DNA, 60 bp, Homo sapiens
gatggaaatcatgaccagaggtgcggcaaatgacttgaaagaattggtcaataaaatgat

SEQ ID NO: 1366 - DNA, 60 bp, Homo sapiens
accgcatccgtgcgtggttatccagaaaatgtaatgaggatgaagattcaccaaataagt

SEQ ID NO: 1367 - DNA, 60 bp, Homo sapiens
gaccagaaacagtaaaaccttttatgacaggggctgcaaaacaaatcaaggacatccttg

SEQ ID NO: 1368 - DNA, 60 bp, Homo sapiens
gtttcctctgcattgggtttgaagtagtttagttatgtctttttctctgtatgtaagtag

SEQ ID NO: 1369 - DNA, 60 bp, Homo sapiens
tgtattatttgtccttcatactatccatccataccacactatcttctgtatcaggtagtc

SEQ ID NO: 1370 - DNA, 60 bp, Homo sapiens
agaggaggaagatttttaaaacctttatcattcagcatttgtattttatggatccccagg

SEQ ID NO: 1371 - DNA, 60 bp, Homo sapiens
aagctctatactttggttaccaatgtacccgttaccgctttcaaaaatctacaggcaatg

SEQ ID NO: 1372 - DNA, 60 bp, Homo sapiens
tatcaatggtgtgagcccaaaggtcaaaggtgttgcagcttcttcccttcgtcaaatctt

SEQ ID NO: 1373 - DNA, 60 bp, Homo sapiens; identical to SEQ ID NO: 795

SEQ ID NO: 1374 - DNA, 60 bp, Homo sapiens
ttagagcaagaatagtatctgctaatgtaagggacatctgtatttaactcctttgtagac

SEQ ID NO: 1375 - DNA, 60 bp, Homo sapiens
aaagctgtctgggccaaaggaataaggaattcctataggcatgtgcggttgtccagaaaa

SEQ ID NO: 1376 - DNA, 60 bp, Homo sapiens; identical to SEQ ID NO: 797

SEQ ID NO: 1377 - DNA, 60 bp, Homo sapiens
ataatagctcatagaatgaattgctgtaccaaccaaggctaaaaagaatttaagtagccc

SEQ ID NO: 1378 - DNA, 60 bp, Homo sapiens
atggtgtaactaaagattttgtttgtgtaatgcatgattaagacaataaagtattttttc

SEQ ID NO: 1379 - DNA, 60 bp, Homo sapiens
gaccatatattacatgggggtacccaaatctgaagtcagtaaatgaacttatctacaagg

SEQ ID NO: 1380 - DNA, 60 bp, Homo sapiens
ggtcatcagaatcagaggtatcaatgtgtgagcccacaggaccaaaaggtattgcaactt

SEQ ID NO: 1381 - DNA, 60 bp, Homo sapiens
gtgaaaatgaagacgacaacgttgtcttagcctttgaacaactgagtacaactttttggg

SEQ ID NO: 1382 - DNA, 60 bp, Homo sapiens
taagaaaataattgctttgacagacaacgctttgattgctccatctcttggtaaatatgg

SEQ ID NO: 1383 - DNA, 60 bp, Homo sapiens
agttgcttcgacagataacactttgattgctcgatctcttggtaaatatagcatcaactg

SEQ ID NO: 1384 - DNA, 60 bp, Homo sapiens
gaaagtgaaagcaattggaagacaaaggttcaaagtccttgagctaagaacacagtcaga

SEQ ID NO: 1385 - DNA, 60 bp, Homo sapiens
ttttttagtgcatcacaatgacaaaggggtggttttctttcacccaagaatgtgctttcc

SEQ ID NO: 1386 - DNA, 60 bp, Homo sapiens
gaaaaacagatctttttcttaagtgaaagcacctttaatttgctctaacggtacatcctg

SEQ ID NO: 1387 - DNA, 60 bp, Homo sapiens
tgtagactgaaggagtctttcaaaacaccccagcattaaatctcactctgcgctgcttct

SEQ ID NO: 1388 - DNA, 60 bp, Homo sapiens
aatggaactcttgaggactttagccaggtgtatataataaaggtacttttgtgctgcatt

SEQ ID NO: 1389 - DNA, 60 bp, Homo sapiens
tgctgcatatgaactcaaatcttacactgaatcaccaacaaaccctcagttttcaccaag

SEQ ID NO: 1390 - DNA, 60 bp, Homo sapiens; identical to SEQ ID NO: 804

SEQ ID NO: 1391 - DNA, 60 bp, Homo sapiens
tgtaactcttgtttctaggtaatcgttctctctcaacaaacttctcaagcgtctgtgtaa

SEQ ID NO: 1392 - DNA, 60 bp, Homo sapiens
cggactagtggaaaagagctagtgaagcagtttctcttcgattctatactgaaggcggat

SEQ ID NO: 1393 - DNA, 60 bp, Homo sapiens
acttccaaccaaatcaaaaatagcaaaaggcatttcaatgcaccttcccacattcacagg

SEQ ID NO: 1394 - DNA, 60 bp, Homo sapiens
cggctgtccagaaaacgtaatgaggatgaagattcaaataagctctatactttggttacc

SEQ ID NO: 1395 - DNA, 60 bp, Homo sapiens
acaccatgaaactgctcaggccatcaagggtatacataaaagccaagaagtatctgaaag

SEQ ID NO: 1396 - DNA, 60 bp, Homo sapiens
agttaacatgctgaggactgtagagccatatattgcctgtgggtacccaaatctgaagtc

SEQ ID NO: 1397 - DNA, 60 bp, Homo sapiens
tcttatgctcagcaccaacagtctgccaaatccagaagaaggtgtaatcatgacctgaga

SEQ ID NO: 1398 - DNA, 60 bp, Homo sapiens
atttaaaggtttcgatgtagattctctggtcgaggatatccaagtgaacaaagcatctaa

SEQ ID NO: 1399 - DNA, 60 bp, Homo sapiens
gtcagtctcaagaaaatgagaattacttcttatctgcttatactgaaagcttggatagag

SEQ ID NO: 1400 - DNA, 60 bp, Homo sapiens
attgtgtgtgatgttcaaataaagtggtatctacattcatgtgatttatgggtcagcatg

SEQ ID NO: 1401 - DNA, 60 bp, Homo sapiens
gctaggtagaatttgtacttgttttcttggtagcagttttgaaatattctgtacagtacg

SEQ ID NO: 1402 - DNA, 60 bp, Homo sapiens
tgtatgctcacttcccccatcaagtcgttatccagaatgggtctcttgttgaaatccgaa

SEQ ID NO: 1403 - DNA, 60 bp, Homo sapiens
aagaagctctgcaacaagatagcaggctatgtcacacatctgatgaagcggattcagaga

SEQ ID NO: 1404 - DNA, 60 bp, Homo sapiens
atgaaagcagtcagaaaagtggctgattctaagaagctggagtctaaattggactacaaa

SEQ ID NO: 1405 - DNA, 60 bp, Homo sapiens
tggttttactaaaaaacgcaacaatcagatacagaagacctcttatgcccagcaccaacg

SEQ ID NO: 1406 - DNA, 60 bp, Homo sapiens
atggcaaaatcaataagagtgaagctttgacagataatgctttgacagctcgatctcttg

SEQ ID NO: 1407 - DNA, 60 bp, Homo sapiens
caagaaaagctggcaactttctatgtacccacaaacccaaattggcatttgtcatcagga

SEQ ID NO: 1408 - DNA, 60 bp, Homo sapiens
ttgtccagagatcatttatattaccttccaaattgtttattacccaagatcctttgggag

SEQ ID NO: 1409 - DNA, 60 bp, Homo sapiens
attaatgcattcacatgatcacttcttgaaaatggttcaaagcatgttttcctgatggtg

SEQ ID NO: 1410 - DNA, 60 bp, Homo sapiens
ccatcaatattcacaagtgcatccatggagtgggcaagaagcgtgcccctcgggaactca

SEQ ID NO: 1411 - DNA, 60 bp, Homo sapiens; identical to SEQ ID NO: 807

SEQ ID NO: 1412 - DNA, 60 bp, Homo sapiens
agatgacaccacagactgttccttcattttcctgtatattctctgtactatgtcgattcg

SEQ ID NO: 1413 - DNA, 60 bp, Homo sapiens
tttcttcaaccactaccttctacattggttgacttagaccgtaagctttttaagtttctc

SEQ ID NO: 1414 - DNA, 60 bp, Homo sapiens
tgaggatgttacctactaaactgaaaacattcattccatatctacttacacatacaccag

SEQ ID NO: 1415 - DNA, 60 bp, Homo sapiens
ttgtgagtttgtttctttgaattttcattttacagttacttttccttgcatacaaacaag

SEQ ID NO: 1416 - DNA, 60 bp, Homo sapiens
tggtgctaagggatactttgtcattatgatgaagtaagtgttaagtgtcagataaatagc

SEQ ID NO: 1417 - DNA, 60 bp, Homo sapiens; identical to SEQ ID NO: 809

SEQ ID NO: 1418 - DNA, 60 bp, Homo sapiens
ggattttctctgttgttaaatcacaaaaatgatagtccccaatcgtttctttataggagg

SEQ ID NO: 1419 - DNA, 60 bp, Homo sapiens
atgtacagtattttgtcctagcagcataaagacctagctcttttcttacaagaggcagaa

SEQ ID NO: 1420 - DNA, 60 bp, Homo sapiens
acatgagctctccctgccgcattgagatgattcttgaaaaggaacagattgttcataaac

SEQ ID NO: 1421 - DNA, 60 bp, Homo sapiens
tactcaacatttggtatattgttttgagtaatggatgtttgttttttgtgtaatttgtga

SEQ ID NO: 1422 - DNA, 60 bp, Homo sapiens
ttttctactgaaggtcagaggataggaaacaagtatttctcttctggtatacatgtaatg

SEQ ID NO: 1423 - DNA, 60 bp, Homo sapiens
aaggagatgggaactcctgatgtgcgcattgatatgaggcacaacaaagtagtctggaaa

SEQ ID NO: 1424 - DNA, 60 bp, Homo sapiens; identical to SEQ ID NO: 812

SEQ ID NO: 1425 - DNA, 60 bp, Homo sapiens
gatgaacttcaaaatgcctcggggacctgtttgaattttttctgcagtgctgtattattt

SEQ ID NO: 1426 - DNA, 60 bp, Homo sapiens
aggctcaacaaagctgtctgggccaaagaaataaggaatatcgataccatatctgtgtta

SEQ ID NO: 1427 - DNA, 60 bp, Homo sapiens
tatgccactgaataaagctacttaaaccagagtaattttgggatattaatcctaggctac

SEQ ID NO: 1428 - DNA, 60 bp, Homo sapiens
tgcatacctactatgtgtaagagcaaatggatgggatttttaaatgaaatttttaggccc

SEQ ID NO: 1429 - DNA, 60 bp, Homo sapiens
taacattatagcacaagtattatctcagtggattatccggaataacatctgaaagatggg

SEQ ID NO: 1430 - DNA, 60 bp, Homo sapiens
tgcagaatgatgaagttgcatttagaaaattcctgattactgaagatgttcagggcaaaa

SEQ ID NO: 1431 - DNA, 60 bp, Homo sapiens
taaaactacaaagaagattgtgctggggcttgagtgcattcagcccaactgcagatccaa

SEQ ID NO: 1432 - DNA, 60 bp, Homo sapiens
tcaagggtttagatgtagattctctggtcattgagtataaccgagtaaacaaagcaccta

SEQ ID NO: 1433 - DNA, 60 bp, Homo sapiens
ccttgctaatttcaaaaactaccagaacatgaatccagatggcatggttgctctggacta

SEQ ID NO: 1434 - DNA, 60 bp, Homo sapiens
ttagaggtttgttggactttcataaattgagtacaatctttgcatcaaactacctgctac

SEQ ID NO: 1435 - DNA, 60 bp, Homo sapiens
gctctgatatgcatttggatgattaatgttatgctgttctttcatgtgaatgtcaagaca

SEQ ID NO: 1436 - DNA, 60 bp, Homo sapiens
tccagttgaacaaatattgagtgcctatcatatgcaagactaactccttactaggaatga

SEQ ID NO: 1437 - DNA, 60 bp, Homo sapiens; identical to SEQ ID NO: 816

SEQ ID NO: 1438 - DNA, 60 bp, Homo sapiens
tacaactatgtgacttagtgcacaacacatttgtgaaataacctactcctatatactgac

SEQ ID NO: 1439 - DNA, 60 bp, Homo sapiens
gtatctaaaactgaacagctactgtgctatattgattttattggtagtattgagcagacc

SEQ ID NO: 1440 - DNA, 60 bp, Homo sapiens
agaaatccggaagacctcttatgctcagtaccagccaaatccggaagaagatgatggaaa

SEQ ID NO: 1441 - DNA, 60 bp, Homo sapiens
cttcaaagaagcaaaaggtggagatgctggcaacagcgaggaccagattaacagtcttat

SEQ ID NO: 1442 - DNA, 60 bp, Homo sapiens
tgtgcggttgcccagaaaacgtaatgcgggtgaagattcaccaaataagctccatacttt

SEQ ID NO: 1443 - DNA, 60 bp, Homo sapiens
cccttttggagataagctttccaaaatatgcgtatgagtaaaattagagaattccaccac

SEQ ID NO: 1444 - DNA, 60 bp, Homo sapiens
gtctatatggtacttgatctacatttaagtggaaaaattagcagtatttgaaagctcagt

SEQ ID NO: 1445 - DNA, 60 bp, Homo sapiens
aacatgagacaatacaaagttacatttttggaccatattaaaactgcaagaagacagggg

SEQ ID NO: 1446 - DNA, 60 bp, Homo sapiens
taatcattccatgccttaatatgcttgcaatacaagaatatcttcagatgggtgaatacc

SEQ ID NO: 1447 - DNA, 60 bp, Homo sapiens
cttcatggcgaaggtagcagttctggaaaagctactggagaagagacaggttctaaagtt

SEQ ID NO: 1448 - DNA, 60 bp, Homo sapiens
ttgaagcttatgttgatgtcaagactatcagtgattatttgctttgtctgttttgtgtgg

SEQ ID NO: 1449 - DNA, 60 bp, Homo sapiens
tagcatatctgcaggaaaatatcttgtttgtagtgatatgccccaatagtgattgatttc

SEQ ID NO: 1450 - DNA, 60 bp, Homo sapiens
ggaagacttcgaggggttcgtgctgtaagacctaaagttcttatgaaattgtcaaaaaga

SEQ ID NO: 1451 - DNA, 60 bp, Homo sapiens; identical to SEQ ID NO: 821

SEQ ID NO: 1452 - DNA, 60 bp, Homo sapiens
gtgtagaagactataaaaagggctttataactgatcttttgacatactcactttgagtgg

SEQ ID NO: 1453 - DNA, 60 bp, Homo sapiens
tcatggtcggattaactcacacgtgatctctccctgccacatcgaaatgatctttagtga

SEQ ID NO: 1454 - DNA, 60 bp, Homo sapiens
ccattagatttgttcttatgtgaccatgtaccaagccagctataaagtattgtatttctg

SEQ ID NO: 1455 - DNA, 60 bp, Homo sapiens
atacagaagacctcttatgctcagcaccaacagaaaagtaaaaatgctgaagaagcccaa

SEQ ID NO: 1456 - DNA, 60 bp, Homo sapiens
ttactgaagatgttcagggcaaaaactgcctaacttccggcatggatcttattcgtgaca

SEQ ID NO: 1457 - DNA, 60 bp, Homo sapiens
agctgatccagattaccaagagaaataccaagaattacttgaaagagaggacttttttcc

SEQ ID NO: 1458 - DNA, 60 bp, Homo sapiens
acttttttatagatacaaatgtatctgtggtagtacaaggactttgttactttggcgtgc

SEQ ID NO: 1459 - DNA, 60 bp, Homo sapiens
agaacgttaacggagttactgaatcaaatggatggatttgatactctgcatagagttaaa

SEQ ID NO: 1460 - DNA, 60 bp, Homo sapiens
acaagttctaggagtttgaactttgggtcaagatgttgattccttttaatgtgcgagggt

SEQ ID NO: 1461 - DNA, 60 bp, Homo sapiens
aacttgtgtcaatgatggtaatgagaccaaacttgtacatttaattaagggtaccagttc

SEQ ID NO: 1462 - DNA, 60 bp, Homo sapiens; identical to SEQ ID NO: 826

SEQ ID NO: 1463 - DNA, 60 bp, Homo sapiens
tgtttaatatgtaacacgtaagaacaattgaaattttcttctaagatttaatactagtct

SEQ ID NO: 1464 - DNA, 60 bp, Homo sapiens
acaaagcccagcagaacaacgtggaacacagagaaactttttctggtgtctctaagaagc

SEQ ID NO: 1465 - DNA, 60 bp, Homo sapiens
aaggtacatccagcagtggtcattgacaagtcataccagagaaaagatggcgtgtttctt

SEQ ID NO: 1466 - DNA, 60 bp, Homo sapiens
gaattgctttgacagataacgctttgcgatctcttggaaaatatggcatcatctgtatgg

SEQ ID NO: 1467 - DNA, 60 bp, Homo sapiens
taaatgaactaatctacaagcgtgcttatggcaaaatcaatttgacttgcactttcctac

SEQ ID NO: 1468 - DNA, 60 bp, Homo sapiens; identical to SEQ ID NO: 827

SEQ ID NO: 1469 - DNA, 60 bp, Homo sapiens
ctgacatgtgataaatatttcagtgacttttcagatttatttcttgttagccgctgtgtc

SEQ ID NO: 1470 - DNA, 60 bp, Homo sapiens
catttggaacaggtttcattctgtttctagatttatgttgttgtagttgaacagcaactg

SEQ ID NO: 1471 - DNA, 60 bp, Homo sapiens
aattgccttcttgtaaccctaagtatggtgaagcagaattgaattctacaaaagtctttc

SEQ ID NO: 1472 - DNA, 60 bp, Homo sapiens
atacatatagagagcggaaccataactcattgaattttggagaggaataagcttagcgtt

SEQ ID NO: 1473 - DNA, 60 bp, Homo sapiens
aaccatgctttcttgtagtactgattgaaacttacacgttttattctactcatagtgagc

SEQ ID NO: 1474 - DNA, 60 bp, Homo sapiens
ggaaatatttctcctctaaatgcatgaaatcatgttgaggtaatctactggagattacac

SEQ ID NO: 1475 - DNA, 60 bp, Homo sapiens
atgctctgaaggttttgtagaagcacaattaaacatctaaaatggctttgttacaccaga

SEQ ID NO: 1476 - DNA, 60 bp, Homo sapiens
tttgatgtagctctaccgatactatgtggtaatgctattttgttttactaacaagctctg

SEQ ID NO: 1477 - DNA, 60 bp, Homo sapiens
aagctgttgaatgagtcttaaaaattatactactgttaagtggaccaagtttggtgaagc

SEQ ID NO: 1478 - DNA, 60 bp, Homo sapiens
aattatgattagtgagtggtctaacagtttaaggcattgataacttacaagtagagtggg

SEQ ID NO: 1479 - DNA, 60 bp, Homo sapiens
tcggagcggaaattgtctataagtaggcatttatttcatgattgatatgtcacagaaatc

SEQ ID NO: 1480 - DNA, 60 bp, Homo sapiens
atgatgtgcagttttgtgcctttatgtatttgccttgttctttgtcgaatgtgtgaaatt

SEQ ID NO: 1481 - DNA, 60 bp, Homo sapiens; identical to SEQ ID NO: 830

SEQ ID NO: 1482 - DNA, 60 bp, Homo sapiens
atgtattcgtgtatccattagtgaatagttcaagtctgtttaagagtgtattgagatggc

SEQ ID NO: 1483 - DNA, 60 bp, Homo sapiens; identical to SEQ ID NO: 831

SEQ ID NO: 1484 - DNA, 60 bp, Homo sapiens
gctatctgtcttttgctgatctacaaataaatgaattgagaatttagtccatagaggtcc

SEQ ID NO: 1485 - DNA, 60 bp, Homo sapiens; identical to SEQ ID NO: 833

SEQ ID NO: 1486 - DNA, 60 bp, Homo sapiens; identical to SEQ ID NO: 834

SEQ ID NO: 1487 - DNA, 60 bp, Homo sapiens
taaaatgctactacagtattctacgatgcaggctgaatgtatattacagtaattctctgg

SEQ ID NO: 1488 - DNA, 60 bp, Homo sapiens
aatcaagctgctcaagatggggttttcaaagacctctcacaatattaaatgcacttcaat

SEQ ID NO: 1489 - DNA, 60 bp, Homo sapiens
ggtactgagcagagtcttaggtaaaagtcttgggaaatatttgggcattggtctggccaa

SEQ ID NO: 1490 - DNA, 60 bp, Homo sapiens
tagagggtgctctttctctagaggagaaacttgccaggagacaagcttctcaagtcttta

SEQ ID NO: 1491 - DNA, 60 bp, Homo sapiens
accaccagtccaagaatctgtttaaagttcagacttaaaacagtaccaaataaaaagtcc

SEQ ID NO: 1492 - DNA, 60 bp, Homo sapiens
gggccttttgggttttattgaatagttcatttcacctgtttaagacttactaccaataag

SEQ ID NO: 1493 - DNA, 60 bp, Homo sapiens
aattgctatcattctaaagtcatggacttcactttcggcaacaaaactaaataaggatgg

SEQ ID NO: 1494 - DNA, 60 bp, Homo sapiens
gggacttaatattttacatcttactagccatgtcataggttttaagtgcttttaatgggg

SEQ ID NO: 1495 - DNA, 60 bp, Homo sapiens
cagtttagggcagtagctgcttttgtcataaatatcttcctaccacatcaaaaatgctgc

SEQ ID NO: 1496 - DNA, 60 bp, Homo sapiens
tgtggtcagaggattatagttgagagtgaagtactatgtgtgagttatagatctctcgaa

SEQ ID NO: 1497 - DNA, 60 bp, Homo sapiens
gtgtgatccatgcccatccgaaaggatgatgaagttcaggttgtacgtggacactataaa

SEQ ID NO: 1498 - DNA, 60 bp, Homo sapiens
tcagggtaaagaatatgaaaaccttagacgtaatccatggtggataggcattatggtttc

SEQ ID NO: 1499 - DNA, 60 bp, Homo sapiens
attagctgggactaaaacggacatgttttgttttgtgaattctacctaaatgtctctcta

SEQ ID NO: 1500 - DNA, 60 bp, Homo sapiens
tctacagacagtcaatgtggatgagaactaatccctgatcgtcagatacatcaaataaag

SEQ ID NO: 1501 - DNA, 60 bp, Homo sapiens
gcttataaagtgtaagtggagacgctaaattgtgagtacaaagtttctttttcacaacag

SEQ ID NO: 1502 - DNA, 60 bp, Homo sapiens
catatattgcatgggggtaccccaatctgaagtcagtaaatgaactaatctacaagagtg

SEQ ID NO: 1503 - DNA, 60 bp, Homo sapiens
agatgggagaacagaggagtagtgacaggagtagaagcactgtagaccttttcatatcat

SEQ ID NO: 1504 - DNA, 60 bp, Homo sapiens
cttgcttcatctgttctgtgttggttttaataaaaaacgcaacaatcagatatggaagac

SEQ ID NO: 1505 - DNA, 60 bp, Homo sapiens
aagtgatccagttctaagtgtcatcttttatcatgaagacaataaaatcttgagtttatg

SEQ ID NO: 1506 - DNA, 60 bp, Homo sapiens
aagtgggacccaaatctacaatggtttgtcaacatgtaatgcctttgaatgaacgacaag

SEQ ID NO: 1507 - DNA, 60 bp, Homo sapiens; identical to SEQ ID NO: 837

SEQ ID NO: 1508 - DNA, 60 bp, Homo sapiens
atccgtgtgcagctgtccagaaaacgtaatgaggatgaagattcaccaaataagccatat

SEQ ID NO: 1509 - DNA, 60 bp, Homo sapiens
catacattggcgtgtacataaacgtttgtggaaaacttagttgtgtgattattctctttg

SEQ ID NO: 1510 - DNA, 60 bp, Homo sapiens; identical to SEQ ID NO: 839

SEQ ID NO: 1511 - DNA, 60 bp, Homo sapiens
gaaaaacagatgttatcctcagcacaaattcagtaaagagactacaaaaggatgatcttc

SEQ ID NO: 1512 - DNA, 60 bp, Homo sapiens
ctgagcataagaggtcttccgtatctgatttttgcgttttttagtaaaaccaacacagaa

SEQ ID NO: 1513 - DNA, 60 bp, Homo sapiens
ttttgtaaaagatggcaagtttgttacctcacttgagtggggttttccttttcccccaat

SEQ ID NO: 1514 - DNA, 60 bp, Homo sapiens
tcaacaggcttattagaaaaatgaaccaaggtgtctaccatgattatttttctaagctgg

SEQ ID NO: 1515 - DNA, 60 bp, Homo sapiens
aaagcatgcttctctctcaaaaagaaaaattaaaggattttattgccagtcgtgtcagtc

SEQ ID NO: 1516 - DNA, 60 bp, Homo sapiens
ttttgctgcacatgctaaaaaatgcagagagtaatggtgaacttaagggtttagatgtag

SEQ ID NO: 1517 - DNA, 60 bp, Homo sapiens; identical to SEQ ID NO: 841

SEQ ID NO: 1518 - DNA, 60 bp, Homo sapiens
aggcatagaagaattgtcctctaaaaatatcaatgatgtatcctggaatgtgaagatgtc

SEQ ID NO: 1519 - DNA, 60 bp, Homo sapiens
ttgatggtcattgtacgagctattgtatggattactgtggagtgctgtttaccacatgat

SEQ ID NO: 1520 - DNA, 60 bp, Homo sapiens
gtatctgagggatgtgctgtaatctgatttacatgcattagagcacacagtagaaaaact

SEQ ID NO: 1521 - DNA, 60 bp, Homo sapiens
taggtatctctcctgaaattctttgcagttcattttttatggcagttaatccagtgaaac

SEQ ID NO: 1522 - DNA, 60 bp, Homo sapiens
acgtcataattgttgagggcaagcttcattgttgatagtgcaaagtgtcgctgttgtgat

SEQ ID NO: 1523 - DNA, 60 bp, Homo sapiens
acttaatcaatgtctcaaacatttctaggcattctccatctcatgcattccttctgttcc

SEQ ID NO: 1524 - DNA, 60 bp, Homo sapiens
aaatgcagagagtgatgctgaacttaagggttcagatgtagattctctggtcattgagca

SEQ ID NO: 1525 - DNA, 60 bp, Homo sapiens
gattatatatgctaggtctgattctgaagatacaagaattcaatggtggaatttgtctcc

SEQ ID NO: 1526 - DNA, 60 bp, Homo sapiens
aatctttgtatctattattacacgtgttgctgaagggagcatggtttttatctgtgatac

SEQ ID NO: 1527 - DNA, 60 bp, Homo sapiens
atttattgtatgttggctagcagttcatccttctgcaaaatatgcattcagagaaatgtg

SEQ ID NO: 1528 - DNA, 60 bp, Homo sapiens
gtaatatacagggtgaactctttactgatacacacaagacaactgttaaaaagtgaatcc

SEQ ID NO: 1529 - DNA, 60 bp, Homo sapiens
ctttcaatctttgtatctattattacacgtgctgctgaagggagcatgtttttatctatg

SEQ ID NO: 1530 - DNA, 60 bp, Homo sapiens
cattgagatgatccttacggaaaaggaacagattgttcctaaaccagaagaggaggttgc

SEQ ID NO: 1531 - DNA, 60 bp, Homo sapiens
cccagcaaggtggttatcactaggctaaaactggacaaagaccgcaaaaagatccttgaa

SEQ ID NO: 1532 - DNA, 60 bp, Homo sapiens
accacatgagtttcttcttttttatttagtaatacgctgctacatatttggaggttctgg

SEQ ID NO: 1533 - DNA, 60 bp, Homo sapiens; identical to SEQ ID NO: 848

SEQ ID NO: 1534 - DNA, 60 bp, Homo sapiens
ggggccaagaagaaagtggttgatccattttctaagaaagattggtatgatgtgaaagca

SEQ ID NO: 1535 - DNA, 60 bp, Homo sapiens
ttgtgcttttagcctgttttccactattaattagcatttaccagtaagggtcattttgac

SEQ ID NO: 1536 - DNA, 60 bp, Homo sapiens
cttaggctcttaattgtagtttaaattccagtactgcctactcagacccaaaagttttgt

SEQ ID NO: 1537 - DNA, 60 bp, Homo sapiens
aagaggagagccacccgatatatgttctctaggccttttagaaaacatgggaatgggtac

SEQ ID NO: 1538 - DNA, 60 bp, Homo sapiens
aacggccatcactatcaagatcagctcatggaaggagtaaagaaaatatctcaaaatgag

SEQ ID NO: 1539 - DNA, 60 bp, Homo sapiens
atccttgaggacttggtcttcacaagcaaaattgtgggcaagagaatccgcgtgaaacta

SEQ ID NO: 1540 - DNA, 60 bp, Homo sapiens
aaaccctgagctttttgctcgtcttggtagcagatatctgtaaaaacctacccagaattg

SEQ ID NO: 1541 - DNA, 60 bp, Homo sapiens; identical to SEQ ID NO: 850

SEQ ID NO: 1542 - DNA, 60 bp, Homo sapiens; identical to SEQ ID NO: 851

SEQ ID NO: 1543 - DNA, 60 bp, Homo sapiens; identical to SEQ ID NO: 853

SEQ ID NO: 1544 - DNA, 60 bp, Homo sapiens
ggaaaagacgtagaaaaggcttgccaatctatttatcctctccatgatgtcttcgttaga

SEQ ID NO: 1545 - DNA, 60 bp, Homo sapiens
agatgtcactttacagaaacagtgtgtaccattccgacattacaacggtggagttggcag

SEQ ID NO: 1546 - DNA, 60 bp, Homo sapiens
caaaactaggctgtcctgaacccctggtaatagaattgttcacctttataccaagaaggt

SEQ ID NO: 1547 - DNA, 60 bp, Homo sapiens
atgccctcattactggacttcattttgatacttgtctatccttcatagtgccctctactt

SEQ ID NO: 1548 - DNA, 60 bp, Homo sapiens; identical to SEQ ID NO: 855

SEQ ID NO: 1549 - DNA, 60 bp, Homo sapiens
actacgaaggtcagcaaattggcaaagtggtccaggtttacaggaagaaatatgttatct

SEQ ID NO: 1550 - DNA, 60 bp, Homo sapiens
ttattggtgcatgtaagccattatcctgtcttaatgaaccgattaatgctgttgattgtt

SEQ ID NO: 1551 - DNA, 60 bp, Homo sapiens; identical to SEQ ID NO: 856

SEQ ID NO: 1552 - DNA, 60 bp, Homo sapiens
aaaggcttccgtattctttgttggtattgtgccactgcagaactttagtgcagagtttat

SEQ ID NO: 1553 - DNA, 60 bp, Homo sapiens
aggattgggaatttgggacatgacatgtactataaaagtcagtctatgtacatactgctt

SEQ ID NO: 1554 - DNA, 60 bp, Homo sapiens
gttgtaaacaaacaagttaagggcaagattcttgccaagagaattaatgtgcgtattgag

SEQ ID NO: 1555 - DNA, 60 bp, Homo sapiens; identical to SEQ ID NO: 857

SEQ ID NO: 1556 - DNA, 60 bp, Homo sapiens
acgaaagtcataccgtagaaaagatggcgtgtttctttattttgaagataatgcaggagt

SEQ ID NO: 1557 - DNA, 60 bp, Homo sapiens
gtagaagagaagaagaaggttcctgctgtgccagaaacccttaagaaaaagcgaaggaat

SEQ ID NO: 1558 - DNA, 60 bp, Homo sapiens
cctctcaaaattggcaggagctaaataatagtttgtgggcgatttgtattgtgtactgta

SEQ ID NO: 1559 - DNA, 60 bp, Homo sapiens; identical to SEQ ID NO: 861

SEQ ID NO: 1560 - DNA, 60 bp, Homo sapiens
gattccagacagcattggaaaagacatagaaaaggcttgccaatctatcctctccatgat

SEQ ID NO: 1561 - DNA, 60 bp, Homo sapiens
tttagaatagccagtgatcactagctaattctcatatccatgcctttttgtcctgtttac

SEQ ID NO: 1562 - DNA, 60 bp, Homo sapiens
aaatgcagactttgttatttgccaaagaagattcatcatgttccttcctttctttttccc

SEQ ID NO: 1563 - DNA, 60 bp, Homo sapiens
aattctgccaaatctggaagaagatgatggaaatcatgacccaagaggtgcagacaaatg

SEQ ID NO: 1564 - DNA, 60 bp, Homo sapiens
aatcagcctgaattttctaaatgcaacttcatcattctgcaaatcagcaagactcacttc

SEQ ID NO: 1565 - DNA, 60 bp, Homo sapiens
agaatcttaggaaatcaccactgttcggttataatcactgcctcctgaatcgttgaggag

SEQ ID NO: 1566 - DNA, 60 bp, Homo sapiens
gttggttttactaaaaaacgcaaaaatcagatacggaagacctcttatgctcagcaccaa

SEQ ID NO: 1567 - DNA, 60 bp, Homo sapiens
tcagtgtacagttccactggaatttgacagttgtctctacagtcatgcaactcgaagtag

SEQ ID NO: 1568 - DNA, 60 bp, Homo sapiens; identical to SEQ ID NO: 863

SEQ ID NO: 1569 - DNA, 60 bp, Homo sapiens
ttgggttacctgccttgaaggaccgaaaatggcagatattcaaaacgtcagcaaccaaag

SEQ ID NO: 1570 - DNA, 60 bp, Homo sapiens
agcagacctgagaaatgtttgtactgaagcaggtatgttcgcaattcgtgctgatcatga

SEQ ID NO: 1571 - DNA, 60 bp, Homo sapiens
gtcatcctcttaatgaagcattatgcagctgttaaagatgatagatgtaaaggttatgag

SEQ ID NO: 1572 - DNA, 60 bp, Homo sapiens; identical to SEQ ID NO: 865

SEQ ID NO: 1573 - DNA, 60 bp, Homo sapiens
acaggcccatacttcagtcagtccaatcatagtacagtgatgtggtggtagatgctatga

SEQ ID NO: 1574 - DNA, 60 bp, Homo sapiens
aaatgttgctcaggtaatcagtattttcttccacgtatgtgcatattgcactgttagatc

SEQ ID NO: 1575 - DNA, 60 bp, Homo sapiens
tgagccttccctgccacattgagatgatccttactgaaaaggaacagattgttcctaaac

SEQ ID NO: 1576 - DNA, 60 bp, Homo sapiens
taatgtcggaatggtacacactgtttctgtaaagtgacatctttcagatacttcgtggct

SEQ ID NO: 1577 - DNA, 60 bp, Homo sapiens
ttataggtcagaaaaatgaggtccacactaattttgcctcttccacagggagatagattc

SEQ ID NO: 1578 - DNA, 60 bp, Homo sapiens
aggttgtacatggacactataaaggtcagcaaattggcaaagtagtccaggtttacagga

SEQ ID NO: 1579 - DNA, 60 bp, Homo sapiens
aacaaagcaggaaaatatattgagaagggatcgtgtttacagaggacttctttaaagtgt

SEQ ID NO: 1580 - DNA, 60 bp, Homo sapiens
gaaagcacagtaatcactgctgtcgatgttgtcatgaaccatcacctgcaggaaacaagt

SEQ ID NO: 1581 - DNA, 60 bp, Homo sapiens
agccctggaacaaactgggtcccaatgatcaatacaagttctgctcagtgaatgtggatt

SEQ ID NO: 1582 - DNA, 60 bp, Homo sapiens
tctgcaggtgactctcgggcccaagcaaccttctggaaaacgggttaataaataaatcaa

SEQ ID NO: 1583 - DNA, 60 bp, Homo sapiens; identical to SEQ ID NO: 870

SEQ ID NO: 1584 - DNA, 60 bp, Homo sapiens; identical to SEQ ID NO: 871

SEQ ID NO: 1585 - DNA, 60 bp, Homo sapiens; identical to SEQ ID NO: 80

SEQ ID NO: 1586 - DNA, 60 bp, Homo sapiens
gggaaccctgggagtagctagtttgctttttgcgtacacagagaaggctatgtaaacaaa

SEQ ID NO: 1587 - DNA, 60 bp, Homo sapiens
ctttctggacggaaccacgtactttttacatacattgattcatgtctcacgtctccctaa

SEQ ID NO: 1588 - DNA, 60 bp, Homo sapiens
gtattggggttcttgtagcttgttaaaaattgtctgctccaatccagggttattaggcca

SEQ ID NO: 1589 - DNA, 60 bp, Homo sapiens
acagtagagacctacacagtgaactttggggacttctgagatcagcgtcctaccaagacc

SEQ ID NO: 1590 - DNA, 60 bp, Homo sapiens
tatggggagatgagcaatcaggaggttatgaagagcattgaggatgggtaccggttgccc

SEQ ID NO: 1591 - DNA, 60 bp, Homo sapiens
gacgcatttttggtaatcacagctggggagtgaaaagggtgccactggcaccactgggtg

SEQ ID NO: 1592 - DNA, 60 bp, Homo sapiens
ggagatctggggctgggaagagaatgtaaagcaacctaaacagtaatttaagaatggaga

SEQ ID NO: 1593 - DNA, 60 bp, Homo sapiens
tcactgcactcctttgtcatatactctgcatcactgtcatactcacaacttcgtgaataa

SEQ ID NO: 1594 - DNA, 60 bp, Homo sapiens
gcctcaggcacaagaaaatgtggactatgtgatcctcaaacattgacactggatgggctg

SEQ ID NO: 1595 - DNA, 60 bp, Homo sapiens
aggcgcctggcacatttcagggagaaactccaaagtccacacaaagattttctaaggaat

SEQ ID NO: 1596 - DNA, 60 bp, Homo sapiens
gaactgaatgcagcctggacactggcctcaataccttgtttaggatttcttcaccctttt

SEQ ID NO: 1597 - DNA, 60 bp, Homo sapiens
gcaaggggctctacgcagactacctcttcaatgctattgccggaaactgggagcgcaaga

SEQ ID NO: 1598 - DNA, 60 bp, Homo sapiens; identical to SEQ ID NO: 168

SEQ ID NO: 1599 - DNA, 60 bp, Homo sapiens
cggctggcctgaaggagggcgactacattgtgtcagtgaatgggcagccatgcaggtggt

SEQ ID NO: 1600 - DNA, 60 bp, Homo sapiens
gcagggggccactgtagtgagcgtggagaaatttggaaacacctatttcttaactcaaat

SEQ ID NO: 1601 - DNA, 60 bp, Homo sapiens
gccagcgctgcggctggattcccatccagtaccccatcatttccgagtgcaagtgctcgt

SEQ ID NO: 1602 - DNA, 60 bp, Homo sapiens
aagagagcaacattttacccacacacagataaagttttcccttgaggaaacaacagcttt

SEQ ID NO: 1603 - DNA, 60 bp, Homo sapiens; identical to SEQ ID NO: 876

SEQ ID NO: 1604 - DNA, 60 bp, Homo sapiens
cccacagcggcaatcaacacgcttctgtgaataaataaaagtttatcattccgtacaaac

SEQ ID NO: 1605 - DNA, 60 bp, Homo sapiens; identical to SEQ ID NO: 878

SEQ ID NO: 1606 - DNA, 60 bp, Homo sapiens; identical to SEQ ID NO: 210

SEQ ID NO: 1607 - DNA, 60 bp, Homo sapiens; identical to SEQ ID NO: 211

SEQ ID NO: 1608 - DNA, 60 bp, Homo sapiens
cccttgtacagaatcgaactctgcacttctctctcctttacgagacgaaaaggaaaagca

SEQ ID NO: 1609 - DNA, 60 bp, Homo sapiens
ctagtaaaatgtcaagaacagacgggagatattagtgtctttccctctatcattaaaggt

SEQ ID NO: 1610 - DNA, 60 bp, Homo sapiens
ctccagggcagacagaaagttggggccagagctaggttttagagatcctacaggatccca

SEQ ID NO: 1611 - DNA, 60 bp, Homo sapiens
tttaccgtgtcacatttactttggtcctctatgtatttaaatgtttgaagtgccttagac

SEQ ID NO: 1612 - DNA, 60 bp, Homo sapiens
cccagaaaacctccagtagtggacaacaggttttcaccatagcctacgttaacccatttt

SEQ ID NO: 1613 - DNA, 60 bp, Homo sapiens
gttttttggtgtgttttctgggtcgtctatgtgtcatatggttttacttttctcccggaa

SEQ ID NO: 1614 - DNA, 60 bp, Homo sapiens
cttgagcacatccttaaaatatcagcacaagttgggggaggcaggcaatggaatataatg

SEQ ID NO: 1615 - DNA, 60 bp, Homo sapiens; identical to SEQ ID NO: 306

SEQ ID NO: 1616 - DNA, 60 bp, Homo sapiens
ttttctttttaataaaaaggcacctataaaacaggtcaatacagtacaggcagcacagag

SEQ ID NO: 1617 - DNA, 60 bp, Homo sapiens
tcccaattttgagagccaaaggctggcgcttctgacttcaggagcgaaaggaggaggcct

SEQ ID NO: 1618 - DNA, 60 bp, Homo sapiens; identical to SEQ ID NO: 351

SEQ ID NO: 1619 - DNA, 60 bp, Homo sapiens; identical to SEQ ID NO: 353

SEQ ID NO: 1620 - DNA, 60 bp, Homo sapiens; identical to SEQ ID NO: 355

SEQ ID NO: 1621 - DNA, 60 bp, Homo sapiens
tccaatttgtaagtgttgagtccactgatgtagaagttctgacttgtaaaccattcatcc

SEQ ID NO: 1622 - DNA, 60 bp, Homo sapiens; identical to SEQ ID NO: 886

SEQ ID NO: 1623 - DNA, 60 bp, Homo sapiens
ggctttaggttggcaaatagcactgttttcttagctgcaagaattcattgcacaatgttt

SEQ ID NO: 1624 - DNA, 60 bp, Homo sapiens
tgcttctacgtccaactaaagggaaaagagggttgaaggtcagccatgttagctatgaga

SEQ ID NO: 1625 - DNA, 60 bp, Homo sapiens
aagaaactgcttgttgtgtatcagtaatcattagtggcaatgatgacattctgaaaagct

SEQ ID NO: 1626 - DNA, 60 bp, Homo sapiens
tgaccacctatgacagcgtgaccatctcctggacccgccagaatggcgaagctgtgaaaa

SEQ ID NO: 1627 - DNA, 60 bp, Homo sapiens; identical to SEQ ID NO: 395

SEQ ID NO: 1628 - DNA, 60 bp, Homo sapiens; identical to SEQ ID NO: 888

SEQ ID NO: 1629 - DNA, 60 bp, Homo sapiens; identical to SEQ ID NO: 400

SEQ ID NO: 1630 - DNA, 60 bp, Homo sapiens; identical to SEQ ID NO: 891

SEQ ID NO: 1631 - DNA, 60 bp, Homo sapiens
gggcaggtaggatttcaatggcatgttacataaccatcctctaaagggacagaatgtaca

SEQ ID NO: 1632 - DNA, 60 bp, Homo sapiens; identical to SEQ ID NO: 422

SEQ ID NO: 1633 - DNA, 60 bp, Homo sapiens; identical to SEQ ID NO: 423

SEQ ID NO: 1634 - DNA, 60 bp, Homo sapiens; identical to SEQ ID NO: 896

SEQ ID NO: 1635 - DNA, 60 bp, Homo sapiens
gttgctttatgtagcaaattctccgtttggagcttttaaaataggattatttgccagaac

SEQ ID NO: 1636 - DNA, 60 bp, Homo sapiens; identical to SEQ ID NO: 897

SEQ ID NO: 1637 - DNA, 60 bp, Homo sapiens; identical to SEQ ID NO: 433

SEQ ID NO: 1638 - DNA, 60 bp, Homo sapiens; identical to SEQ ID NO: 434

SEQ ID NO: 1639 - DNA, 60 bp, Homo sapiens
agtcactccagaaggtgagagctctgcaactgagggcctgcgagctctgttacgaaggaa

SEQ ID NO: 1640 - DNA, 60 bp, Homo sapiens; identical to SEQ ID NO: 901

SEQ ID NO: 1641 - DNA, 60 bp, Homo sapiens
tgtggtttctctttaacagattcagggcctcatcctttgactcggaaccaggaaggaatt

SEQ ID NO: 1642 - DNA, 60 bp, Homo sapiens; identical to SEQ ID NO: 441

SEQ ID NO: 1643 - DNA, 60 bp, Homo sapiens; identical to SEQ ID NO: 442

SEQ ID NO: 1644 - DNA, 60 bp, Homo sapiens
gccccatttcaagtataaccaggagggaaaatggtgcttgaaataagcatgccacaaagg

SEQ ID NO: 1645 - DNA, 60 bp, Homo sapiens; identical to SEQ ID NO: 906

SEQ ID NO: 1646 - DNA, 60 bp, Homo sapiens; identical to SEQ ID NO: 446

SEQ ID NO: 1647 - DNA, 60 bp, Homo sapiens; identical to SEQ ID NO: 447

SEQ ID NO: 1648 - DNA, 60 bp, Homo sapiens
cttagaagctgctctttagcccagatacacatactcttttttgtctttgtgcaataatca

SEQ ID NO: 1649 - DNA, 60 bp, Homo sapiens
ctgtgaacttgtcaaacatcatgcactgaactattttaaattctactcaggagacatttc

SEQ ID NO: 1650 - DNA, 60 bp, Homo sapiens; identical to SEQ ID NO: 909

SEQ ID NO: 1651 - DNA, 60 bp, Homo sapiens; identical to SEQ ID NO: 457

SEQ ID NO: 1652 - DNA, 60 bp, Homo sapiens; identical to SEQ ID NO: 458

SEQ ID NO: 1653 - DNA, 60 bp, Homo sapiens; identical to SEQ ID NO: 459

SEQ ID NO: 1654 - DNA, 60 bp, Homo sapiens; identical to SEQ ID NO: 912

SEQ ID NO: 1655 - DNA, 60 bp, Homo sapiens; identical to SEQ ID NO: 466

SEQ ID NO: 1656 - DNA, 60 bp, Homo sapiens; identical to SEQ ID NO: 467

SEQ ID NO: 1657 - DNA, 60 bp, Homo sapiens; identical to SEQ ID NO: 469

SEQ ID NO: 1658 - DNA, 60 bp, Homo sapiens; identical to SEQ ID NO: 915

SEQ ID NO: 1659 - DNA, 60 bp, Homo sapiens
agcctccgtctagactctcatgtccttctgtgtcagctggttgacttgaatattgatcaa

SEQ ID NO: 1660 - DNA, 60 bp, Homo sapiens
ccccactgttttgccccagagaaatacatagtgaagattcttcccatattcttcctacta

SEQ ID NO: 1661 - DNA, 60 bp, Homo sapiens
accctctaggaggagtttggaaagttgtcaaggttttcaattgtctggaggatgtggttc

SEQ ID NO: 1662 - DNA, 60 bp, Homo sapiens; identical to SEQ ID NO: 473

SEQ ID NO: 1663 - DNA, 60 bp, Homo sapiens; identical to SEQ ID NO: 918

SEQ ID NO: 1664 - DNA, 60 bp, Homo sapiens; identical to SEQ ID NO: 478

SEQ ID NO: 1665 - DNA, 60 bp, Homo sapiens
ctggaggttgttggcattggttcagtgtctcagggaggtcagggctcagttcactgtttc

SEQ ID NO: 1666 - DNA, 60 bp, Homo sapiens; identical to SEQ ID NO: 483

SEQ ID NO: 1667 - DNA, 60 bp, Homo sapiens
aaaggaggaggatccctggaccagggactttcacaggaaccaaacatgattcatgaaaaa

SEQ ID NO: 1668 - DNA, 60 bp, Homo sapiens
ggctcagaccttaagaactgatggtcttttcttttacttctacacaaaagtctaagcagt

SEQ ID NO: 1669 - DNA, 60 bp, Homo sapiens; identical to SEQ ID NO: 491

SEQ ID NO: 1670 - DNA, 60 bp, Homo sapiens
atatgccagagtttttattcgtcttgtgattgctgacatacctgtgcactcatgtgtata

SEQ ID NO: 1671 - DNA, 60 bp, Homo sapiens
acctagcacagtggagtgaaacactttaaatagcacttgttccttgagtatatatggaaa

SEQ ID NO: 1672 - DNA, 60 bp, Homo sapiens
aaatatcctgatactttagcatatctgcaattataagaattaaatatcaaattataccat

SEQ ID NO: 1673 - DNA, 60 bp, Homo sapiens; identical to SEQ ID NO: 924

SEQ ID NO: 1674 - DNA, 60 bp, Homo sapiens; identical to SEQ ID NO: 498

SEQ ID NO: 1675 - DNA, 60 bp, Homo sapiens; identical to SEQ ID NO: 505

SEQ ID NO: 1676 - DNA, 60 bp, Homo sapiens
gacattaaaatgagtggagaagaaacctgaaagcgccgcagagaataagactaaaatttc

SEQ ID NO: 1677 - DNA, 60 bp, Homo sapiens
acaactacctgtagctggggagaacatcttcacatgccccataaactccattttggcaaa

SEQ ID NO: 1678 - DNA, 60 bp, Homo sapiens; identical to SEQ ID NO: 506

SEQ ID NO: 1679 - DNA, 60 bp, Homo sapiens; identical to SEQ ID NO: 507

SEQ ID NO: 1680 - DNA, 60 bp, Homo sapiens; identical to SEQ ID NO: 508

SEQ ID NO: 1681 - DNA, 60 bp, Homo sapiens; identical to SEQ ID NO: 509

SEQ ID NO: 1682 - DNA, 60 bp, Homo sapiens; identical to SEQ ID NO: 510

SEQ ID NO: 1683 - DNA, 60 bp, Homo sapiens
gcctcaatcacatttgtgatggccaacaaatttacctaagcattttgctaacctgaagaa

SEQ ID NO: 1684 - DNA, 60 bp, Homo sapiens; identical to SEQ ID NO: 515

SEQ ID NO: 1685 - DNA, 60 bp, Homo sapiens; identical to SEQ ID NO: 517

SEQ ID NO: 1686 - DNA, 60 bp, Homo sapiens
ctggccagagagtcaactgccaacccttccccagtcgagatcgggggttctttgtgataa

SEQ ID NO: 1687 - DNA, 60 bp, Homo sapiens; identical to SEQ ID NO: 523

SEQ ID NO: 1688 - DNA, 60 bp, Homo sapiens; identical to SEQ ID NO: 938

SEQ ID NO: 1689 - DNA, 60 bp, Homo sapiens; identical to SEQ ID NO: 939

SEQ ID NO: 1690 - DNA, 60 bp, Homo sapiens; identical to SEQ ID NO: 525

SEQ ID NO: 1691 - DNA, 60 bp, Homo sapiens; identical to SEQ ID NO: 526

SEQ ID NO: 1692 - DNA, 60 bp, Homo sapiens; identical to SEQ ID NO: 530

SEQ ID NO: 1693 - DNA, 60 bp, Homo sapiens; identical to SEQ ID NO: 531

SEQ ID NO: 1694 - DNA, 60 bp, Homo sapiens
gttgccttcgtcaaacctggtgaggttttgtactatctttagtctcactacatgcagcag

SEQ ID NO: 1695 - DNA, 60 bp, Homo sapiens
aggaggcaagtgattgttctctacaaccgcagacatacttataccttccaaggagaccat

SEQ ID NO: 1696 - DNA, 60 bp, Homo sapiens
gcaccttctgttcactcccacaaagtggtgtctggttctcactgagacgttttaagattt

SEQ ID NO: 1697 - DNA, 60 bp, Homo sapiens; identical to SEQ ID NO: 535

SEQ ID NO: 1698 - DNA, 60 bp, Homo sapiens; identical to SEQ ID NO: 944

SEQ ID NO: 1699 - DNA, 60 bp, Homo sapiens; identical to SEQ ID NO: 537

SEQ ID NO: 1700 - DNA, 60 bp, Homo sapiens; identical to SEQ ID NO: 538

SEQ ID NO: 1701 - DNA, 60 bp, Homo sapiens; identical to SEQ ID NO: 541

SEQ ID NO: 1702 - DNA, 60 bp, Homo sapiens; identical to SEQ ID NO: 548

SEQ ID NO: 1703 - DNA, 60 bp, Homo sapiens; identical to SEQ ID NO: 949

SEQ ID NO: 1704 - DNA, 60 bp, Homo sapiens; identical to SEQ ID NO: 550

SEQ ID NO: 1705 - DNA, 60 bp, Homo sapiens; identical to SEQ ID NO: 552

SEQ ID NO: 1706 - DNA, 60 bp, Homo sapiens; identical to SEQ ID NO: 554

SEQ ID NO: 1707 - DNA, 60 bp, Homo sapiens; identical to SEQ ID NO: 556

SEQ ID NO: 1708 - DNA, 60 bp, Homo sapiens; identical to SEQ ID NO: 955

SEQ ID NO: 1709 - DNA, 60 bp, Homo sapiens; identical to SEQ ID NO: 956

SEQ ID NO: 1710 - DNA, 60 bp, Homo sapiens
tttacagctctgtaacctcccgttgcgtcaagtctaaaccaagattatgtgacttgcaat

SEQ ID NO: 1711 - DNA, 60 bp, Homo sapiens; identical to SEQ ID NO: 960

SEQ ID NO: 1712 - DNA, 60 bp, Homo sapiens; identical to SEQ ID NO: 961

SEQ ID NO: 1713 - DNA, 60 bp, Homo sapiens; identical to SEQ ID NO: 963

SEQ ID NO: 1714 - DNA, 60 bp, Homo sapiens; identical to SEQ ID NO: 559

SEQ ID NO: 1715 - DNA, 60 bp, Homo sapiens
aacatgctagttcaaaataagactgctcagtttccaagggttttcaagcctacttacctt

SEQ ID NO: 1716 - DNA, 60 bp, Homo sapiens; identical to SEQ ID NO: 965

SEQ ID NO: 1717 - DNA, 60 bp, Homo sapiens; identical to SEQ ID NO: 966

SEQ ID NO: 1718 - DNA, 60 bp, Homo sapiens; identical to SEQ ID NO: 968

SEQ ID NO: 1719 - DNA, 60 bp, Homo sapiens; identical to SEQ ID NO: 561

SEQ ID NO: 1720 - DNA, 60 bp, Homo sapiens; identical to SEQ ID NO: 970

SEQ ID NO: 1721 - DNA, 60 bp, Homo sapiens; identical to SEQ ID NO: 971

SEQ ID NO: 1722 - DNA, 60 bp, Homo sapiens; identical to SEQ ID NO: 565

SEQ ID NO: 1723 - DNA, 60 bp, Homo sapiens; identical to SEQ ID NO: 973

SEQ ID NO: 1724 - DNA, 60 bp, Homo sapiens
ctgagctacctgagcgtaaggggcgggttcaacatgtcctctttcaagttaaaagaataa

SEQ ID NO: 1725 - DNA, 60 bp, Homo sapiens; identical to SEQ ID NO: 974

SEQ ID NO: 1726 - DNA, 60 bp, Homo sapiens; identical to SEQ ID NO: 568

SEQ ID NO: 1727 - DNA, 60 bp, Homo sapiens; identical to SEQ ID NO: 976

SEQ ID NO: 1728 - DNA, 60 bp, Homo sapiens; identical to SEQ ID NO: 979

SEQ ID NO: 1729 - DNA, 60 bp, Homo sapiens; identical to SEQ ID NO: 980

SEQ ID NO: 1730 - DNA, 60 bp, Homo sapiens; identical to SEQ ID NO: 981

SEQ ID NO: 1731 - DNA, 60 bp, Homo sapiens; identical to SEQ ID NO: 570

SEQ ID NO: 1732 - DNA, 60 bp, Homo sapiens
tgctacattccaggcattgtactaagtatggggaaccacagagaagacattccctcagaa

SEQ ID NO: 1733 - DNA, 60 bp, Homo sapiens; identical to SEQ ID NO: 983

SEQ ID NO: 1734 - DNA, 60 bp, Homo sapiens; identical to SEQ ID NO: 574

SEQ ID NO: 1735 - DNA, 60 bp, Homo sapiens; identical to SEQ ID NO: 575

SEQ ID NO: 1736 - DNA, 60 bp, Homo sapiens
ccaccaaattatgtcgtgagctatatagcaaagaacaagagcacaaatgtaagccttgtc

SEQ ID NO: 1737 - DNA, 60 bp, Homo sapiens; identical to SEQ ID NO: 986

SEQ ID NO: 1738 - DNA, 60 bp, Homo sapiens; identical to SEQ ID NO: 579

SEQ ID NO: 1739 - DNA, 60 bp, Homo sapiens; identical to SEQ ID NO: 581

SEQ ID NO: 1740 - DNA, 60 bp, Homo sapiens; identical to SEQ ID NO: 582

SEQ ID NO: 1741 - DNA, 60 bp, Homo sapiens
agcaacccagtaagtacagttatcaaaaatactaggaaactatatccatatcgcttttgg

SEQ ID NO: 1742 - DNA, 60 bp, Homo sapiens
gaatgaatatggtttgtgctggaagcctccgaggtggaaaaaactcgtgcaatggagatt

SEQ ID NO: 1743 - DNA, 60 bp, Homo sapiens; identical to SEQ ID NO: 584

SEQ ID NO: 1744 - DNA, 60 bp, Homo sapiens
taaattacacctgtgtgcacctgtattactgaatataggaaagagatacccattacatag

SEQ ID NO: 1745 - DNA, 60 bp, Homo sapiens; identical to SEQ ID NO: 990

SEQ ID NO: 1746 - DNA, 60 bp, Homo sapiens
atttggggacaaaaaggcaggcttcatttttcatatgtttgatgaaaactggctcaagat

SEQ ID NO: 1747 - DNA, 60 bp, Homo sapiens
ctggtctgaagggtcacggggctgtcaacaggtgttccttactcataattgattattcaa

SEQ ID NO: 1748 - DNA, 60 bp, Homo sapiens; identical to SEQ ID NO: 991

SEQ ID NO: 1749 - DNA, 60 bp, Homo sapiens; identical to SEQ ID NO: 992

SEQ ID NO: 1750 - DNA, 60 bp, Homo sapiens
caccgacaagaactcactactgggcatggagggtgccaacagcatcttttccgggttcct

SEQ ID NO: 1751 - DNA, 60 bp, Homo sapiens
tgtagtatccatatgttgcttaaatttccttatgagccccatgatggaaagacttaaaga

SEQ ID NO: 1752 - DNA, 60 bp, Homo sapiens; identical to SEQ ID NO: 588

SEQ ID NO: 1753 - DNA, 60 bp, Homo sapiens
ttttgagttccagttgactgcagaggacatgaaagccatagatggcctagacagaaatct

SEQ ID NO: 1754 - DNA, 60 bp, Homo sapiens; identical to SEQ ID NO: 590

SEQ ID NO: 1755 - DNA, 60 bp, Homo sapiens; identical to SEQ ID NO: 997

SEQ ID NO: 1756 - DNA, 60 bp, Homo sapiens; identical to SEQ ID NO: 592

SEQ ID NO: 1757 - DNA, 60 bp, Homo sapiens; identical to SEQ ID NO: 998

SEQ ID NO: 1758 - DNA, 60 bp, Homo sapiens; identical to SEQ ID NO: 593

SEQ ID NO: 1759 - DNA, 60 bp, Homo sapiens
tatgctgtgttttctttaaaagtcatatgggttcgtggcctaatgccttggattttacat

SEQ ID NO: 1760 - DNA, 60 bp, Homo sapiens; identical to SEQ ID NO: 1000

SEQ ID NO: 1761 - DNA, 60 bp, Homo sapiens
agaatgcctggttttcgtttgcaatttgcttgtgtaaatcaggttgtaaaaaggcagata

SEQ ID NO: 1762 - DNA, 60 bp, Homo sapiens; identical to SEQ ID NO: 1002

SEQ ID NO: 1763 - DNA, 60 bp, Homo sapiens; identical to SEQ ID NO: 595

SEQ ID NO: 1764 - DNA, 60 bp, Homo sapiens; identical to SEQ ID NO: 596

SEQ ID NO: 1765 - DNA, 60 bp, Homo sapiens; identical to SEQ ID NO: 1006

SEQ ID NO: 1766 - DNA, 60 bp, Homo sapiens; identical to SEQ ID NO: 597

SEQ ID NO: 1767 - DNA, 60 bp, Homo sapiens; identical to SEQ ID NO: 598

SEQ ID NO: 1768 - DNA, 60 bp, Homo sapiens
gcatgtatatcaatttatatagataggtagatagcttttggatgattgaggcatgcttat

SEQ ID NO: 1769 - DNA, 60 bp, Homo sapiens; identical to SEQ ID NO: 1009

SEQ ID NO: 1770 - DNA, 60 bp, Homo sapiens; identical to SEQ ID NO: 601

SEQ ID NO: 1771 - DNA, 60 bp, Homo sapiens; identical to SEQ ID NO: 1012

SEQ ID NO: 1772 - DNA, 60 bp, Homo sapiens
gtggtaacccaaatatgacctgtcctagtaacaaaactcgcaaaaattgtcaccacagtg

SEQ ID NO: 1773 - DNA, 60 bp, Homo sapiens; identical to SEQ ID NO: 602

SEQ ID NO: 1774 - DNA, 60 bp, Homo sapiens; identical to SEQ ID NO: 1014

SEQ ID NO: 1775 - DNA, 60 bp, Homo sapiens; identical to SEQ ID NO: 607

SEQ ID NO: 1776 - DNA, 60 bp, Homo sapiens; identical to SEQ ID NO: 608

SEQ ID NO: 1777 - DNA, 60 bp, Homo sapiens; identical to SEQ ID NO: 1018

SEQ ID NO: 1778 - DNA, 60 bp, Homo sapiens; identical to SEQ ID NO: 1019

SEQ ID NO: 1779 - DNA, 60 bp, Homo sapiens; identical to SEQ ID NO: 1020

SEQ ID NO: 1780 - DNA, 60 bp, Homo sapiens; identical to SEQ ID NO: 609

SEQ ID NO: 1781 - DNA, 60 bp, Homo sapiens
ggatagtaaaacttgagaagcttttggggtcagatctctggaacatcatgtgatgaagct

SEQ ID NO: 1782 - DNA, 60 bp, Homo sapiens; identical to SEQ ID NO: 1022

SEQ ID NO: 1783 - DNA, 60 bp, Homo sapiens; identical to SEQ ID NO: 610

SEQ ID NO: 1784 - DNA, 60 bp, Homo sapiens
ttgtaggactgcagttctgaattttgggttaaaggttttggctgctgtaagaatgtgaat

SEQ ID NO: 1785 - DNA, 60 bp, Homo sapiens; identical to SEQ ID NO: 1024

SEQ ID NO: 1786 - DNA, 60 bp, Homo sapiens; identical to SEQ ID NO: 1025

SEQ ID NO: 1787 - DNA, 60 bp, Homo sapiens; identical to SEQ ID NO: 1027

SEQ ID NO: 1788 - DNA, 60 bp, Homo sapiens; identical to SEQ ID NO: 1029

SEQ ID NO: 1789 - DNA, 60 bp, Homo sapiens; identical to SEQ ID NO: 1031

SEQ ID NO: 1790 - DNA, 60 bp, Homo sapiens; identical to SEQ ID NO: 1032

SEQ ID NO: 1791 - DNA, 60 bp, Homo sapiens; identical to SEQ ID NO: 1033

SEQ ID NO: 1792 - DNA, 60 bp, Homo sapiens; identical to SEQ ID NO: 1035

SEQ ID NO: 1793 - DNA, 60 bp, Homo sapiens; identical to SEQ ID NO: 1037

SEQ ID NO: 1794 - DNA, 60 bp, Homo sapiens; identical to SEQ ID NO: 616

SEQ ID NO: 1795 - DNA, 60 bp, Homo sapiens; identical to SEQ ID NO: 618

SEQ ID NO: 1796 - DNA, 60 bp, Homo sapiens; identical to SEQ ID NO: 1040

SEQ ID NO: 1797 - DNA, 60 bp, Homo sapiens; identical to SEQ ID NO: 1041

SEQ ID NO: 1798 - DNA, 60 bp, Homo sapiens
acttctcagatcaatcgtgcatccttagtgaacttctgttgtcctcaagcatggtctttc

SEQ ID NO: 1799 - DNA, 60 bp, Homo sapiens; identical to SEQ ID NO: 1042

SEQ ID NO: 1800 - DNA, 60 bp, Homo sapiens; identical to SEQ ID NO: 1043

SEQ ID NO: 1801 - DNA, 60 bp, Homo sapiens; identical to SEQ ID NO: 619

SEQ ID NO: 1802 - DNA, 60 bp, Homo sapiens; identical to SEQ ID NO: 1046

SEQ ID NO: 1803 - DNA, 60 bp, Homo sapiens; identical to SEQ ID NO: 1047

SEQ ID NO: 1804 - DNA, 60 bp, Homo sapiens; identical to SEQ ID NO: 621

SEQ ID NO: 1805 - DNA, 60 bp, Homo sapiens
gtaataattgcagtagttgtattgtattgtatttttgcacgtgtggtaagcataggcttg

SEQ ID NO: 1806 - DNA, 60 bp, Homo sapiens
acggggctgtaaattaccatttactagattagccaaatagtctgaatttccagaaaacaa

SEQ ID NO: 1807 - DNA, 60 bp, Homo sapiens; identical to SEQ ID NO: 1053

SEQ ID NO: 1808 - DNA, 60 bp, Homo sapiens; identical to SEQ ID NO: 1054

SEQ ID NO: 1809 - DNA, 60 bp, Homo sapiens; identical to SEQ ID NO: 1055

SEQ ID NO: 1810 - DNA, 60 bp, Homo sapiens; identical to SEQ ID NO: 1056

SEQ ID NO: 1811 - DNA, 60 bp, Homo sapiens; identical to SEQ ID NO: 1058

SEQ ID NO: 1812 - DNA, 60 bp, Homo sapiens; identical to SEQ ID NO: 1059

SEQ ID NO: 1813 - DNA, 60 bp, Homo sapiens; identical to SEQ ID NO: 1060

SEQ ID NO: 1814 - DNA, 60 bp, Homo sapiens; identical to SEQ ID NO: 1061

SEQ ID NO: 1815 - DNA, 60 bp, Homo sapiens
gggatcattatcagtaatttcatagcaactgttctagtgttttgtgtttttaaaacagaa

SEQ ID NO: 1816 - DNA, 60 bp, Homo sapiens; identical to SEQ ID NO: 1062

SEQ ID NO: 1817 - DNA, 60 bp, Homo sapiens; identical to SEQ ID NO: 1065

SEQ ID NO: 1818 - DNA, 60 bp, Homo sapiens
gcttatgaaatgtcatttaaagttcacttcttgagcatcaataaaaagggaagctgtgtg

SEQ ID NO: 1819 - DNA, 60 bp, Homo sapiens
ctgtgtttatatggaagaaagtaaggtgcttggagtttacctggcttatttaatatgctt

SEQ ID NO: 1820 - DNA, 60 bp, Homo sapiens
caagcttccttctttctaacccccagactttggcctctgagtgaaatgtctctctttgcc

SEQ ID NO: 1821 - DNA, 60 bp, Homo sapiens; identical to SEQ ID NO: 632

SEQ ID NO: 1822 - DNA, 60 bp, Homo sapiens; identical to SEQ ID NO: 1068

SEQ ID NO: 1823 - DNA, 60 bp, Homo sapiens; identical to SEQ ID NO: 633

SEQ ID NO: 1824 - DNA, 60 bp, Homo sapiens
gcctctgagagggtcttgttctagatttcatattgcacttggagggtaacagctgctttt

SEQ ID NO: 1825 - DNA, 60 bp, Homo sapiens; identical to SEQ ID NO: 1071

SEQ ID NO: 1826 - DNA, 60 bp, Homo sapiens; identical to SEQ ID NO: 636

SEQ ID NO: 1827 - DNA, 60 bp, Homo sapiens; identical to SEQ ID NO: 1072

SEQ ID NO: 1828 - DNA, 60 bp, Homo sapiens
ttccctgtctctgaaagacctttctctggaagaggagtctgcattgtagtgtctcaaaga

SEQ ID NO: 1829 - DNA, 60 bp, Homo sapiens
ggttgatgcttttgaagaacgacataaaagttggggaattgactgtctttttgaaaagtt

SEQ ID NO: 1830 - DNA, 60 bp, Homo sapiens
ttttttcagaggtaaactctagattactgtgtcaacccaatactatttggccatagatgt

SEQ ID NO: 1831 - DNA, 60 bp, Homo sapiens; identical to SEQ ID NO: 1073

SEQ ID NO: 1832 - DNA, 60 bp, Homo sapiens
actcagaaaaacatctaaagctgttggagaagagggactcatataaatagttggattgcg

SEQ ID NO: 1833 - DNA, 60 bp, Homo sapiens; identical to SEQ ID NO: 1074

SEQ ID NO: 1834 - DNA, 60 bp, Homo sapiens; identical to SEQ ID NO: 1075

SEQ ID NO: 1835 - DNA, 60 bp, Homo sapiens; identical to SEQ ID NO: 1076

SEQ ID NO: 1836 - DNA, 60 bp, Homo sapiens
cactgataggaaggtccacatccacaaagtttctcttgagttttgttatgtgttttgctg

SEQ ID NO: 1837 - DNA, 60 bp, Homo sapiens; identical to SEQ ID NO: 1077

SEQ ID NO: 1838 - DNA, 60 bp, Homo sapiens; identical to SEQ ID NO: 1078

SEQ ID NO: 1839 - DNA, 60 bp, Homo sapiens
gggctaacttaaaagagttttttcaatgctgcagtgactgaagaagcagtccactcccat

SEQ ID NO: 1840 - DNA, 60 bp, Homo sapiens
ttatttctcttgcattaatagtactgctgtttttgttttgcttctttatatttatgtcta

SEQ ID NO: 1841 - DNA, 60 bp, Homo sapiens
atgtggctgagaaaagaactgtttgagtgccattaagaattctgcatcagacttagatac

SEQ ID NO: 1842 - DNA, 60 bp, Homo sapiens; identical to SEQ ID NO: 638

SEQ ID NO: 1843 - DNA, 60 bp, Homo sapiens
catcagtctgtggtttattttgtcatcagattacttgtgggtatacctaccccaaaattg

SEQ ID NO: 1844 - DNA, 60 bp, Homo sapiens; identical to SEQ ID NO: 1080

SEQ ID NO: 1845 - DNA, 60 bp, Homo sapiens; identical to SEQ ID NO: 1081

SEQ ID NO: 1846 - DNA, 60 bp, Homo sapiens; identical to SEQ ID NO: 1082

SEQ ID NO: 1847 - DNA, 60 bp, Homo sapiens; identical to SEQ ID NO: 1083

SEQ ID NO: 1848 - DNA, 60 bp, Homo sapiens; identical to SEQ ID NO: 1084

SEQ ID NO: 1849 - DNA, 60 bp, Homo sapiens; identical to SEQ ID NO: 1085

SEQ ID NO: 1850 - DNA, 60 bp, Homo sapiens; identical to SEQ ID NO: 1086

SEQ ID NO: 1851 - DNA, 60 bp, Homo sapiens; identical to SEQ ID NO: 1088

SEQ ID NO: 1852 - DNA, 60 bp, Homo sapiens; identical to SEQ ID NO: 644

SEQ ID NO: 1853 - DNA, 60 bp, Homo sapiens; identical to SEQ ID NO: 1090

SEQ ID NO: 1854 - DNA, 60 bp, Homo sapiens
catttaacccacgcagagtattctggcataagaatgaacccgacaactctcagggagaaa

SEQ ID NO: 1855 - DNA, 60 bp, Homo sapiens; identical to SEQ ID NO: 645

SEQ ID NO: 1856 - DNA, 60 bp, Homo sapiens
gcgtccatggatacaagataagatgtgtaccttagtagaatacagagctttggtaattac

SEQ ID NO: 1857 - DNA, 60 bp, Homo sapiens; identical to SEQ ID NO: 1092

SEQ ID NO: 1858 - DNA, 60 bp, Homo sapiens; identical to SEQ ID NO: 1093

SEQ ID NO: 1859 - DNA, 60 bp, Homo sapiens; identical to SEQ ID NO: 1094

SEQ ID NO: 1860 - DNA, 60 bp, Homo sapiens; identical to SEQ ID NO: 1097

SEQ ID NO: 1861 - DNA, 60 bp, Homo sapiens; identical to SEQ ID NO: 1098

SEQ ID NO: 1862 - DNA, 60 bp, Homo sapiens
actaccgtaaggatggtcagtatgaccccatatatgattttttaaggaatggtttagaaa

SEQ ID NO: 1863 - DNA, 60 bp, Homo sapiens; identical to SEQ ID NO: 1101

SEQ ID NO: 1864 - DNA, 60 bp, Homo sapiens; identical to SEQ ID NO: 650

SEQ ID NO: 1865 - DNA, 60 bp, Homo sapiens; identical to SEQ ID NO: 1103

SEQ ID NO: 1866 - DNA, 60 bp, Homo sapiens; identical to SEQ ID NO: 1104

SEQ ID NO: 1867 - DNA, 60 bp, Homo sapiens
atgtccattttggagacagatatgatagaactagaaattaagttgcatttctgcaagtgc

SEQ ID NO: 1868 - DNA, 60 bp, Homo sapiens; identical to SEQ ID NO: 1105

SEQ ID NO: 1869 - DNA, 60 bp, Homo sapiens; identical to SEQ ID NO: 1107

SEQ ID NO: 1870 - DNA, 60 bp, Homo sapiens
tggccccggattgcatccaatgctggcagcattgcatgattctccagtatatttgtaaaa

SEQ ID NO: 1871 - DNA, 60 bp, Homo sapiens; identical to SEQ ID NO: 654

SEQ ID NO: 1872 - DNA, 60 bp, Homo sapiens; identical to SEQ ID NO: 656

SEQ ID NO: 1873 - DNA, 60 bp, Homo sapiens; identical to SEQ ID NO: 1111

SEQ ID NO: 1874 - DNA, 60 bp, Homo sapiens; identical to SEQ ID NO: 1112

SEQ ID NO: 1875 - DNA, 60 bp, Homo sapiens
aaatgggactctatattgttgtagttcaggtcttcattgactaagagattgagagaaatc

SEQ ID NO: 1876 - DNA, 60 bp, Homo sapiens; identical to SEQ ID NO: 661

SEQ ID NO: 1877 - DNA, 60 bp, Homo sapiens; identical to SEQ ID NO: 1118

SEQ ID NO: 1878 - DNA, 60 bp, Homo sapiens; identical to SEQ ID NO: 1119

SEQ ID NO: 1879 - DNA, 60 bp, Homo sapiens; identical to SEQ ID NO: 662

SEQ ID NO: 1880 - DNA, 60 bp, Homo sapiens; identical to SEQ ID NO: 1121

SEQ ID NO: 1881 - DNA, 60 bp, Homo sapiens; identical to SEQ ID NO: 1122

SEQ ID NO: 1882 - DNA, 60 bp, Homo sapiens; identical to SEQ ID NO: 1123

SEQ ID NO: 1883 - DNA, 60 bp, Homo sapiens; identical to SEQ ID NO: 666

SEQ ID NO: 1884 - DNA, 60 bp, Homo sapiens; identical to SEQ ID NO: 1125

SEQ ID NO: 1885 - DNA, 60 bp, Homo sapiens; identical to SEQ ID NO: 1126

SEQ ID NO: 1886 - DNA, 60 bp, Homo sapiens
tctaggaaagggatcttctagtttctgtgttgtttagactcaaagaatcacaaatttgtc

SEQ ID NO: 1887 - DNA, 60 bp, Homo sapiens; identical to SEQ ID NO: 1127

SEQ ID NO: 1888 - DNA, 60 bp, Homo sapiens; identical to SEQ ID NO: 667

SEQ ID NO: 1889 - DNA, 60 bp, Homo sapiens; identical to SEQ ID NO: 1130

SEQ ID NO: 1890 - DNA, 60 bp, Homo sapiens; identical to SEQ ID NO: 1132

SEQ ID NO: 1891 - DNA, 60 bp, Homo sapiens; identical to SEQ ID NO: 1133

SEQ ID NO: 1892 - DNA, 60 bp, Homo sapiens; identical to SEQ ID NO: 672

SEQ ID NO: 1893 - DNA, 60 bp, Homo sapiens
tgtgacttaatgttgatgctttgctttgtcttttggctggcctaacctacattgacatgt

SEQ ID NO: 1894 - DNA, 60 bp, Homo sapiens; identical to SEQ ID NO: 1135

SEQ ID NO: 1895 - DNA, 60 bp, Homo sapiens; identical to SEQ ID NO: 675

SEQ ID NO: 1896 - DNA, 60 bp, Homo sapiens; identical to SEQ ID NO: 1136

SEQ ID NO: 1897 - DNA, 60 bp, Homo sapiens; identical to SEQ ID NO: 1137

SEQ ID NO: 1898 - DNA, 60 bp, Homo sapiens; identical to SEQ ID NO: 1138

SEQ ID NO: 1899 - DNA, 60 bp, Homo sapiens; identical to SEQ ID NO: 1139

SEQ ID NO: 1900 - DNA, 60 bp, Homo sapiens; identical to SEQ ID NO: 678

SEQ ID NO: 1901 - DNA, 60 bp, Homo sapiens; identical to SEQ ID NO: 1140

SEQ ID NO: 1902 - DNA, 60 bp, Homo sapiens; identical to SEQ ID NO: 1141

SEQ ID NO: 1903 - DNA, 60 bp, Homo sapiens; identical to SEQ ID NO: 679

SEQ ID NO: 1904 - DNA, 60 bp, Homo sapiens; identical to SEQ ID NO: 680

SEQ ID NO: 1905 - DNA, 60 bp, Homo sapiens; identical to SEQ ID NO: 1144

SEQ ID NO: 1906 - DNA, 60 bp, Homo sapiens; identical to SEQ ID NO: 1147

SEQ ID NO: 1907 - DNA, 60 bp, Homo sapiens
atataaattagctttttccagaaggatccttttgtagcagtgtttatgaatgtaaccccc

SEQ ID NO: 1908 - DNA, 60 bp, Homo sapiens
aaggagaagaaagaaagtctttttgtggtctctggagatacttttcattcatttcctcat

SEQ ID NO: 1909 - DNA, 60 bp, Homo sapiens; identical to SEQ ID NO: 1148

SEQ ID NO: 1910 - DNA, 60 bp, Homo sapiens; identical to SEQ ID NO: 1149

SEQ ID NO: 1911 - DNA, 60 bp, Homo sapiens
agaccttggaaatgtggacataagctctttctttccttttgttactgtatttagtttgtg

SEQ ID NO: 1912 - DNA, 60 bp, Homo sapiens
atgaccaagtgaaggaactaatggactgtattgaggatctgttgatggagaaaaatggtg

SEQ ID NO: 1913 - DNA, 60 bp, Homo sapiens; identical to SEQ ID NO: 682

SEQ ID NO: 1914 - DNA, 60 bp, Homo sapiens; identical to SEQ ID NO: 1151

SEQ ID NO: 1915 - DNA, 60 bp, Homo sapiens; identical to SEQ ID NO: 683

SEQ ID NO: 1916 - DNA, 60 bp, Homo sapiens; identical to SEQ ID NO: 1153

SEQ ID NO: 1917 - DNA, 60 bp, Homo sapiens; identical to SEQ ID NO: 686

SEQ ID NO: 1918 - DNA, 60 bp, Homo sapiens; identical to SEQ ID NO: 1154

SEQ ID NO: 1919 - DNA, 60 bp, Homo sapiens; identical to SEQ ID NO: 1155

SEQ ID NO: 1920 - DNA, 60 bp, Homo sapiens; identical to SEQ ID NO: 1156

SEQ ID NO: 1921 - DNA, 60 bp, Homo sapiens; identical to SEQ ID NO: 1157

SEQ ID NO: 1922 - DNA, 60 bp, Homo sapiens; identical to SEQ ID NO: 1158

SEQ ID NO: 1923 - DNA, 60 bp, Homo sapiens
ggggctttacaatcctaaggttggcgttgtaatgaagttccacttggttcaggtttcttt

SEQ ID NO: 1924 - DNA, 60 bp, Homo sapiens
atacagttgcatgtaaagggagcttctcatttaattcagcggatgtgggtatttttaggg

SEQ ID NO: 1925 - DNA, 60 bp, Homo sapiens; identical to SEQ ID NO: 689

SEQ ID NO: 1926 - DNA, 60 bp, Homo sapiens; identical to SEQ ID NO: 1165

SEQ ID NO: 1927 - DNA, 60 bp, Homo sapiens; identical to SEQ ID NO: 1167

SEQ ID NO: 1928 - DNA, 60 bp, Homo sapiens; identical to SEQ ID NO: 692

SEQ ID NO: 1929 - DNA, 60 bp, Homo sapiens; identical to SEQ ID NO: 1169

SEQ ID NO: 1930 - DNA, 60 bp, Homo sapiens; identical to SEQ ID NO: 1170

SEQ ID NO: 1931 - DNA, 60 bp, Homo sapiens; identical to SEQ ID NO: 694

SEQ ID NO: 1932 - DNA, 60 bp, Homo sapiens
cagccatcctttttaagagtaagttggttacttcaaaaagagcaaacactggggatcaaa

SEQ ID NO: 1933 - DNA, 60 bp, Homo sapiens; identical to SEQ ID NO: 1173

SEQ ID NO: 1934 - DNA, 60 bp, Homo sapiens; identical to SEQ ID NO: 697

SEQ ID NO: 1935 - DNA, 60 bp, Homo sapiens; identical to SEQ ID NO: 698

SEQ ID NO: 1936 - DNA, 60 bp, Homo sapiens; identical to SEQ ID NO: 699

SEQ ID NO: 1937 - DNA, 60 bp, Homo sapiens
tttgtaaagactggtgctgttcattcatattgggaagaccctttcttttgtgaccatagg

SEQ ID NO: 1938 - DNA, 60 bp, Homo sapiens
atacatatttgggttggtactggttgaatccttcagttaactgctttgttgctttttgca

SEQ ID NO: 1939 - DNA, 60 bp, Homo sapiens
aaatgcacataattcatatttcaggtggtatttgcattcagtgccttactggtattctca

SEQ ID NO: 1940 - DNA, 60 bp, Homo sapiens
gttccaatgacagagcagctaatgtctgttatcaggaatttgatgtgcctgcagttttcc

SEQ ID NO: 1941 - DNA, 60 bp, Homo sapiens; identical to SEQ ID NO: 701

SEQ ID NO: 1942 - DNA, 60 bp, Homo sapiens; identical to SEQ ID NO: 1179

SEQ ID NO: 1943 - DNA, 60 bp, Homo sapiens; identical to SEQ ID NO: 1182

SEQ ID NO: 1944 - DNA, 60 bp, Homo sapiens
acctgcctaagttgtacaatttcagaatgcaattttcattataatgagttccagtgactc

SEQ ID NO: 1945 - DNA, 60 bp, Homo sapiens
ttctaaagccattgtagtcctgtaatggaagcatctagcatgtcgtcaaagctgaaatgg

SEQ ID NO: 1946 - DNA, 60 bp, Homo sapiens
tataggcattctgatgggaacttgtgtgttaaagtaacagatgatttagtttgtttggtg

SEQ ID NO: 1947 - DNA, 60 bp, Homo sapiens; identical to SEQ ID NO: 1183

SEQ ID NO: 1948 - DNA, 60 bp, Homo sapiens; identical to SEQ ID NO: 1184

SEQ ID NO: 1949 - DNA, 60 bp, Homo sapiens; identical to SEQ ID NO: 1186

SEQ ID NO: 1950 - DNA, 60 bp, Homo sapiens
gtggacgagcagatgctcaacgtgcagaacaagaacagcagctacttcgtggagtggatc

SEQ ID NO: 1951 - DNA, 60 bp, Homo sapiens; identical to SEQ ID NO: 1188

SEQ ID NO: 1952 - DNA, 60 bp, Homo sapiens; identical to SEQ ID NO: 1189

SEQ ID NO: 1953 - DNA, 60 bp, Homo sapiens; identical to SEQ ID NO: 1191

SEQ ID NO: 1954 - DNA, 60 bp, Homo sapiens; identical to SEQ ID NO: 707

SEQ ID NO: 1955 - DNA, 60 bp, Homo sapiens; identical to SEQ ID NO: 1193

SEQ ID NO: 1956 - DNA, 60 bp, Homo sapiens; identical to SEQ ID NO: 708

SEQ ID NO: 1957 - DNA, 60 bp, Homo sapiens; identical to SEQ ID NO: 1195

SEQ ID NO: 1958 - DNA, 60 bp, Homo sapiens; identical to SEQ ID NO: 1196

SEQ ID NO: 1959 - DNA, 60 bp, Homo sapiens
tccgagcgtaagaagcctctggacattgactacatgggggaggaacagctccgggagaaa

SEQ ID NO: 1960 - DNA, 60 bp, Homo sapiens; identical to SEQ ID NO: 1197

SEQ ID NO: 1961 - DNA, 60 bp, Homo sapiens; identical to SEQ ID NO: 1198

SEQ ID NO: 1962 - DNA, 60 bp, Homo sapiens; identical to SEQ ID NO: 1199

SEQ ID NO: 1963 - DNA, 60 bp, Homo sapiens; identical to SEQ ID NO: 1200

SEQ ID NO: 1964 - DNA, 60 bp, Homo sapiens
ccagcttctagcttgagagaagggatattttaaatgagatcattaacgtgaaactattac

SEQ ID NO: 1965 - DNA, 60 bp, Homo sapiens; identical to SEQ ID NO: 711

SEQ ID NO: 1966 - DNA, 60 bp, Homo sapiens; identical to SEQ ID NO: 712

SEQ ID NO: 1967 - DNA, 60 bp, Homo sapiens; identical to SEQ ID NO: 1201

SEQ ID NO: 1968 - DNA, 60 bp, Homo sapiens; identical to SEQ ID NO: 1203

SEQ ID NO: 1969 - DNA, 60 bp, Homo sapiens; identical to SEQ ID NO: 1204

SEQ ID NO: 1970 - DNA, 60 bp, Homo sapiens; identical to SEQ ID NO: 713

SEQ ID NO: 1971 - DNA, 60 bp, Homo sapiens; identical to SEQ ID NO: 714

SEQ ID NO: 1972 - DNA, 60 bp, Homo sapiens; identical to SEQ ID NO: 1207

SEQ ID NO: 1973 - DNA, 60 bp, Homo sapiens; identical to SEQ ID NO: 715

SEQ ID NO: 1974 - DNA, 60 bp, Homo sapiens
aagatagatccagaaaatgcagaattcctgactgctctctgtgagctccgactttccatt

SEQ ID NO: 1975 - DNA, 60 bp, Homo sapiens; identical to SEQ ID NO: 716

SEQ ID NO: 1976 - DNA, 60 bp, Homo sapiens
agagggcaacacatctgtgtaagctgctttttagtgtgtttatctgaaggccgttttcca

SEQ ID NO: 1977 - DNA, 60 bp, Homo sapiens; identical to SEQ ID NO: 1216

SEQ ID NO: 1978 - DNA, 60 bp, Homo sapiens; identical to SEQ ID NO: 1217

SEQ ID NO: 1979 - DNA, 60 bp, Homo sapiens; identical to SEQ ID NO: 1219

SEQ ID NO: 1980 - DNA, 60 bp, Homo sapiens
gtttagctcttacactctatccttcctagaaaatggtaattgagattactcagatattaa

SEQ ID NO: 1981 - DNA, 60 bp, Homo sapiens
atttgtgtcttactaaagcagcttattgtaggtgttggcgttctaaaacgtttcctgcct

SEQ ID NO: 1982 - DNA, 60 bp, Homo sapiens; identical to SEQ ID NO: 720

SEQ ID NO: 1983 - DNA, 60 bp, Homo sapiens; identical to SEQ ID NO: 722

SEQ ID NO: 1984 - DNA, 60 bp, Homo sapiens; identical to SEQ ID NO: 1223

SEQ ID NO: 1985 - DNA, 60 bp, Homo sapiens; identical to SEQ ID NO: 1224

SEQ ID NO: 1986 - DNA, 60 bp, Homo sapiens; identical to SEQ ID NO: 1225

SEQ ID NO: 1987 - DNA, 60 bp, Homo sapiens; identical to SEQ ID NO: 1226

SEQ ID NO: 1988 - DNA, 60 bp, Homo sapiens; identical to SEQ ID NO: 1227

SEQ ID NO: 1989 - DNA, 60 bp, Homo sapiens
tttgtgggaattttacataaatctttgttaattactgagtgggcaagtagacttcctgtc

SEQ ID NO: 1990 - DNA, 60 bp, Homo sapiens
cgaggagcagaaaatcgttgtgaaagtgttgaaggcacaagcacagagtcagaaagctaa

SEQ ID NO: 1991 - DNA, 60 bp, Homo sapiens
cgaacccctggtaatagaattgtttacctttataccaagaaggttgggaaagcaccaaaa

SEQ ID NO: 1992 - DNA, 60 bp, Homo sapiens; identical to SEQ ID NO: 1230

SEQ ID NO: 1993 - DNA, 60 bp, Homo sapiens
gattattgtgttctttgcatattcatgtaaaactgatgtgtgaatgacattgcagtgagc

SEQ ID NO: 1994 - DNA, 60 bp, Homo sapiens; identical to SEQ ID NO: 1231

SEQ ID NO: 1995 - DNA, 60 bp, Homo sapiens; identical to SEQ ID NO: 1233

SEQ ID NO: 1996 - DNA, 60 bp, Homo sapiens; identical to SEQ ID NO: 1235

SEQ ID NO: 1997 - DNA, 60 bp, Homo sapiens; identical to SEQ ID NO: 724

SEQ ID NO: 1998 - DNA, 60 bp, Homo sapiens; identical to SEQ ID NO: 725

SEQ ID NO: 1999 - DNA, 60 bp, Homo sapiens; identical to SEQ ID NO: 1237

SEQ ID NO: 2000 - DNA, 60 bp, Homo sapiens
caccaaaagatcaacagacaaatgctccagaaatctatgctgactgtgacacaagagcct

SEQ ID NO: 2001 - DNA, 60 bp, Homo sapiens; identical to SEQ ID NO: 1238

SEQ ID NO: 2002 - DNA, 60 bp, Homo sapiens; identical to SEQ ID NO: 726

SEQ ID NO: 2003 - DNA, 60 bp, Homo sapiens; identical to SEQ ID NO: 1242

SEQ ID NO: 2004 - DNA, 60 bp, Homo sapiens; identical to SEQ ID NO: 730

SEQ ID NO: 2005 - DNA, 60 bp, Homo sapiens; identical to SEQ ID NO: 731

SEQ ID NO: 2006 - DNA, 60 bp, Homo sapiens; identical to SEQ ID NO: 732

SEQ ID NO: 2007 - DNA, 60 bp, Homo sapiens; identical to SEQ ID NO: 739

SEQ ID NO: 2008 - DNA, 60 bp, Homo sapiens; identical to SEQ ID NO: 1252

SEQ ID NO: 2009 - DNA, 60 bp, Homo sapiens
aacagctggggacaactgcggtgatgatgtaaaaaccttcccataaaatgtaagaaaagc

SEQ ID NO: 2010 - DNA, 60 bp, Homo sapiens; identical to SEQ ID NO: 742

SEQ ID NO: 2011 - DNA, 60 bp, Homo sapiens; identical to SEQ ID NO: 1255

SEQ ID NO: 2012 - DNA, 60 bp, Homo sapiens; identical to SEQ ID NO: 1256

SEQ ID NO: 2013 - DNA, 60 bp, Homo sapiens; identical to SEQ ID NO: 1259

SEQ ID NO: 2014 - DNA, 60 bp, Homo sapiens; identical to SEQ ID NO: 1260

SEQ ID NO: 2015 - DNA, 60 bp, Homo sapiens; identical to SEQ ID NO: 1261

SEQ ID NO: 2016 - DNA, 60 bp, Homo sapiens; identical to SEQ ID NO: 743

SEQ ID NO: 2017 - DNA, 60 bp, Homo sapiens; identical to SEQ ID NO: 1264

SEQ ID NO: 2018 - DNA, 60 bp, Homo sapiens; identical to SEQ ID NO: 744

SEQ ID NO: 2019 - DNA, 60 bp, Homo sapiens; identical to SEQ ID NO: 1266

SEQ ID NO: 2020 - DNA, 60 bp, Homo sapiens; identical to SEQ ID NO: 745

SEQ ID NO: 2021 - DNA, 60 bp, Homo sapiens; identical to SEQ ID NO: 1269

SEQ ID NO: 2022 - DNA, 60 bp, Homo sapiens; identical to SEQ ID NO: 1270

SEQ ID NO: 2023 - DNA, 60 bp, Homo sapiens
atgccctaaagttaataccagcagtcatattttatcagatgtaaatctggatgtaagctc

SEQ ID NO: 2024 - DNA, 60 bp, Homo sapiens; identical to SEQ ID NO: 748

SEQ ID NO: 2025 - DNA, 60 bp, Homo sapiens; identical to SEQ ID NO: 1272

SEQ ID NO: 2026 - DNA, 60 bp, Homo sapiens; identical to SEQ ID NO: 1276

SEQ ID NO: 2027 - DNA, 60 bp, Homo sapiens; identical to SEQ ID NO: 1277

SEQ ID NO: 2028 - DNA, 60 bp, Homo sapiens; identical to SEQ ID NO: 752

SEQ ID NO: 2029 - DNA, 60 bp, Homo sapiens
cagacccgtctacaaaaggtttttagagttgaaatatgaaatgtgatgtgggtatggaaa

SEQ ID NO: 2030 - DNA, 60 bp, Homo sapiens; identical to SEQ ID NO: 1280

SEQ ID NO: 2031 - DNA, 60 bp, Homo sapiens; identical to SEQ ID NO: 1282

SEQ ID NO: 2032 - DNA, 60 bp, Homo sapiens; identical to SEQ ID NO: 753

SEQ ID NO: 2033 - DNA, 60 bp, Homo sapiens; identical to SEQ ID NO: 756

SEQ ID NO: 2034 - DNA, 60 bp, Homo sapiens; identical to SEQ ID NO: 758

SEQ ID NO: 2035 - DNA, 60 bp, Homo sapiens; identical to SEQ ID NO: 1286

SEQ ID NO: 2036 - DNA, 60 bp, Homo sapiens
gctatggtgggcagactaagccgattttccagaaaaaggctaaaactacaaagaatactg

SEQ ID NO: 2037 - DNA, 60 bp, Homo sapiens; identical to SEQ ID NO: 762

SEQ ID NO: 2038 - DNA, 60 bp, Homo sapiens; identical to SEQ ID NO: 763

SEQ ID NO: 2039 - DNA, 60 bp, Homo sapiens
ggtgttgcttgttcagtatgtcaaacccagaaacatgaattaatccttgaaggaaatgac

SEQ ID NO: 2040 - DNA, 60 bp, Homo sapiens; identical to SEQ ID NO: 1291

SEQ ID NO: 2041 - DNA, 60 bp, Homo sapiens; identical to SEQ ID NO: 1292

SEQ ID NO: 2042 - DNA, 60 bp, Homo sapiens; identical to SEQ ID NO: 1294

SEQ ID NO: 2043 - DNA, 60 bp, Homo sapiens; identical to SEQ ID NO: 1295

SEQ ID NO: 2044 - DNA, 60 bp, Homo sapiens; identical to SEQ ID NO: 1296

SEQ ID NO: 2045 - DNA, 60 bp, Homo sapiens; identical to SEQ ID NO: 1297

SEQ ID NO: 2046 - DNA, 60 bp, Homo sapiens; identical to SEQ ID NO: 1298

SEQ ID NO: 2047 - DNA, 60 bp, Homo sapiens; identical to SEQ ID NO: 1299

SEQ ID NO: 2048 - DNA, 60 bp, Homo sapiens
gggtgacatttgtaacatttcctctttgagactctgagttcacctagagaagtctaagca

SEQ ID NO: 2049 - DNA, 60 bp, Homo sapiens; identical to SEQ ID NO: 1300

SEQ ID NO: 2050 - DNA, 60 bp, Homo sapiens; identical to SEQ ID NO: 1301

SEQ ID NO: 2051 - DNA, 60 bp, Homo sapiens; identical to SEQ ID NO: 1302

SEQ ID NO: 2052 - DNA, 60 bp, Homo sapiens; identical to SEQ ID NO: 1303

SEQ ID NO: 2053 - DNA, 60 bp, Homo sapiens
acacaaacaaggtgtgtgaggagatccccattatcctcagcaagaagctccacaacagga

SEQ ID NO: 2054 - DNA, 60 bp, Homo sapiens; identical to SEQ ID NO: 1304

SEQ ID NO: 2055 - DNA, 60 bp, Homo sapiens; identical to SEQ ID NO: 1305

SEQ ID NO: 2056 - DNA, 60 bp, Homo sapiens; identical to SEQ ID NO: 1306

SEQ ID NO: 2057 - DNA, 60 bp, Homo sapiens; identical to SEQ ID NO: 1307

SEQ ID NO: 2058 - DNA, 60 bp, Homo sapiens
gaagtaacttgacccaaaacaccttttatgtttgcttagggtatattttttcagtgtctg

SEQ ID NO: 2059 - DNA, 60 bp, Homo sapiens
tttttctggaaaacagacggattttacttctggagacatggcatacggttactgacttat

SEQ ID NO: 2060 - DNA, 60 bp, Homo sapiens; identical to SEQ ID NO: 1309

SEQ ID NO: 2061 - DNA, 60 bp, Homo sapiens; identical to SEQ ID NO: 1310

SEQ ID NO: 2062 - DNA, 60 bp, Homo sapiens; identical to SEQ ID NO: 1312

SEQ ID NO: 2063 - DNA, 60 bp, Homo sapiens; identical to SEQ ID NO: 1313

SEQ ID NO: 2064 - DNA, 60 bp, Homo sapiens; identical to SEQ ID NO: 1314

SEQ ID NO: 2065 - DNA, 60 bp, Homo sapiens; identical to SEQ ID NO: 1315

SEQ ID NO: 2066 - DNA, 60 bp, Homo sapiens; identical to SEQ ID NO: 771

SEQ ID NO: 2067 - DNA, 60 bp, Homo sapiens; identical to SEQ ID NO: 772

SEQ ID NO: 2068 - DNA, 60 bp, Homo sapiens; identical to SEQ ID NO: 773

SEQ ID NO: 2069 - DNA, 60 bp, Homo sapiens; identical to SEQ ID NO: 774

SEQ ID NO: 2070 - DNA, 60 bp, Homo sapiens
ataagataattcacaccggagagaaaccatacaaatgtaaggtttgtgacaaggcttttg

SEQ ID NO: 2071 - DNA, 60 bp, Homo sapiens; identical to SEQ ID NO: 1318

SEQ ID NO: 2072 - DNA, 60 bp, Homo sapiens; identical to SEQ ID NO: 776

SEQ ID NO: 2073 - DNA, 60 bp, Homo sapiens
cacgccatgaaacaggccgtcatggaaatgatgagtcagaagattcagcagctcacagcc

SEQ ID NO: 2074 - DNA, 60 bp, Homo sapiens; identical to SEQ ID NO: 1320

SEQ ID NO: 2075 - DNA, 60 bp, Homo sapiens; identical to SEQ ID NO: 1321

SEQ ID NO: 2076 - DNA, 60 bp, Homo sapiens
gtcacgcaaaagattttcagaaaatgttcggatataattagctctgttaaatacccacag

SEQ ID NO: 2077 - DNA, 60 bp, Homo sapiens
tgtttacctttataccaagaaggttgggaaagcaccaaaatctgcatgtggtgtgtgccc

SEQ ID NO: 2078 - DNA, 60 bp, Homo sapiens
ggtggaagatctaaggagtcttcatgtacttcattaaaaaataacatggattccatactg

SEQ ID NO: 2079 - DNA, 60 bp, Homo sapiens; identical to SEQ ID NO: 1322

SEQ ID NO: 2080 - DNA, 60 bp, Homo sapiens; identical to SEQ ID NO: 1323

SEQ ID NO: 2081 - DNA, 60 bp, Homo sapiens; identical to SEQ ID NO: 1325

SEQ ID NO: 2082 - DNA, 60 bp, Homo sapiens; identical to SEQ ID NO: 1326

SEQ ID NO: 2083 - DNA, 60 bp, Homo sapiens; identical to SEQ ID NO: 780

SEQ ID NO: 2084 - DNA, 60 bp, Homo sapiens
tccatctttttaaatgacattaccatgagtctgttgtcaaacctaaatatctttgtttga

SEQ ID NO: 2085 - DNA, 60 bp, Homo sapiens; identical to SEQ ID NO: 781

SEQ ID NO: 2086 - DNA, 60 bp, Homo sapiens
aaggctaagcttcactgtaaaataataactgggaattctggattgtgtatgggtgttggt

SEQ ID NO: 2087 - DNA, 60 bp, Homo sapiens
cttgctttccatgacacttcccctcaagcaccaacacgttttctgttgatatcgaaaaaa

SEQ ID NO: 2088 - DNA, 60 bp, Homo sapiens; identical to SEQ ID NO: 1328

SEQ ID NO: 2089 - DNA, 60 bp, Homo sapiens; identical to SEQ ID NO: 1329

SEQ ID NO: 2090 - DNA, 60 bp, Homo sapiens; identical to SEQ ID NO: 1330

SEQ ID NO: 2091 - DNA, 60 bp, Homo sapiens; identical to SEQ ID NO: 1331

SEQ ID NO: 2092 - DNA, 60 bp, Homo sapiens
cacgtgcttaaaaacacagagagtaatgctgaacttaagggtgattctctggtcattgag

SEQ ID NO: 2093 - DNA, 60 bp, Homo sapiens; identical to SEQ ID NO: 1332

SEQ ID NO: 2094 - DNA, 60 bp, Homo sapiens; identical to SEQ ID NO: 1333

SEQ ID NO: 2095 - DNA, 60 bp, Homo sapiens; identical to SEQ ID NO: 1334

SEQ ID NO: 2096 - DNA, 60 bp, Homo sapiens
gggtgaccaggtctgggttgaaaaagaccccaaaaagggtcacatttaccagggctctga

SEQ ID NO: 2097 - DNA, 60 bp, Homo sapiens; identical to SEQ ID NO: 1335

SEQ ID NO: 2098 - DNA, 60 bp, Homo sapiens; identical to SEQ ID NO: 1336

SEQ ID NO: 2099 - DNA, 60 bp, Homo sapiens; identical to SEQ ID NO: 1337

SEQ ID NO: 2100 - DNA, 60 bp, Homo sapiens; identical to SEQ ID NO: 1338

SEQ ID NO: 2101 - DNA, 60 bp, Homo sapiens; identical to SEQ ID NO: 1339

SEQ ID NO: 2102 - DNA, 60 bp, Homo sapiens; identical to SEQ ID NO: 1340

SEQ ID NO: 2103 - DNA, 60 bp, Homo sapiens; identical to SEQ ID NO: 1342

SEQ ID NO: 2104 - DNA, 60 bp, Homo sapiens; identical to SEQ ID NO: 1343

SEQ ID NO: 2105 - DNA, 60 bp, Homo sapiens
gtttcagttacttagatggtctcataaggtttctgatacaatttgaagacagaaatctgc

SEQ ID NO: 2106 - DNA, 60 bp, Homo sapiens; identical to SEQ ID NO: 1344

SEQ ID NO: 2107 - DNA, 60 bp, Homo sapiens; identical to SEQ ID NO: 1347

SEQ ID NO: 2108 - DNA, 60 bp, Homo sapiens; identical to SEQ ID NO: 1348

SEQ ID NO: 2109 - DNA, 60 bp, Homo sapiens; identical to SEQ ID NO: 791

SEQ ID NO: 2110 - DNA, 60 bp, Homo sapiens
attcatagtagcatacagaacatgatcaaaggtgttacactggacttccattacaatatg

SEQ ID NO: 2111 - DNA, 60 bp, Homo sapiens; identical to SEQ ID NO: 1351

SEQ ID NO: 2112 - DNA, 60 bp, Homo sapiens; identical to SEQ ID NO: 1352

SEQ ID NO: 2113 - DNA, 60 bp, Homo sapiens; identical to SEQ ID NO: 1353

SEQ ID NO: 2114 - DNA, 60 bp, Homo sapiens; identical to SEQ ID NO: 1354

SEQ ID NO: 2115 - DNA, 60 bp, Homo sapiens; identical to SEQ ID NO: 1355

SEQ ID NO: 2116 - DNA, 60 bp, Homo sapiens; identical to SEQ ID NO: 792

SEQ ID NO: 2117 - DNA, 60 bp, Homo sapiens; identical to SEQ ID NO: 1357

SEQ ID NO: 2118 - DNA, 60 bp, Homo sapiens
gaggagaggcacccgatatatggtctctaagcgttttagaaaacaagtttttcctttggc

SEQ ID NO: 2119 - DNA, 60 bp, Homo sapiens; identical to SEQ ID NO: 1358

SEQ ID NO: 2120 - DNA, 60 bp, Homo sapiens; identical to SEQ ID NO: 1359

SEQ ID NO: 2121 - DNA, 60 bp, Homo sapiens; identical to SEQ ID NO: 1360

SEQ ID NO: 2122 - DNA, 60 bp, Homo sapiens
ccctccactgagagttggctgaaacaaagaatttgtcctgtatggaaaacgggagacttt

SEQ ID NO: 2123 - DNA, 60 bp, Homo sapiens; identical to SEQ ID NO: 1362

SEQ ID NO: 2124 - DNA, 60 bp, Homo sapiens; identical to SEQ ID NO: 1363

SEQ ID NO: 2125 - DNA, 60 bp, Homo sapiens; identical to SEQ ID NO: 1364

SEQ ID NO: 2126 - DNA, 60 bp, Homo sapiens; identical to SEQ ID NO: 1365

SEQ ID NO: 2127 - DNA, 60 bp, Homo sapiens
aatgtggcttctctaatgtagtttctttgattaccgactacacaattatgtaccatcaca

SEQ ID NO: 2128 - DNA, 60 bp, Homo sapiens; identical to SEQ ID NO: 1990

SEQ ID NO: 2129 - DNA, 60 bp, Homo sapiens
cccaaatgcctagaacatcacataaggcactaaatgcctcatgttttactgacgggaatt

SEQ ID NO: 2130 - DNA, 60 bp, Homo sapiens
tatgcagtgaggtttggcaaaatctattccatgtgtgatttgcttgtagaaacaattttg

SEQ ID NO: 2131 - DNA, 60 bp, Homo sapiens
agagaaaacagagacaattatgttcccgagatctcagtcctggatcaggagaccgttgaa

SEQ ID NO: 2132 - DNA, 60 bp, Homo sapiens; identical to SEQ ID NO: 1366

SEQ ID NO: 2133 - DNA, 60 bp, Homo sapiens; identical to SEQ ID NO: 1367

SEQ ID NO: 2134 - DNA, 60 bp, Homo sapiens; identical to SEQ ID NO: 1369

SEQ ID NO: 2135 - DNA, 60 bp, Homo sapiens; identical to SEQ ID NO: 1370

SEQ ID NO: 2136 - DNA, 60 bp, Homo sapiens; identical to SEQ ID NO: 1371

SEQ ID NO: 2137 - DNA, 60 bp, Homo sapiens; identical to SEQ ID NO: 1372

SEQ ID NO: 2138 - DNA, 60 bp, Homo sapiens; identical to SEQ ID NO: 795

SEQ ID NO: 2139 - DNA, 60 bp, Homo sapiens; identical to SEQ ID NO: 1374

SEQ ID NO: 2140 - DNA, 60 bp, Homo sapiens; identical to SEQ ID NO: 1375

SEQ ID NO: 2141 - DNA, 60 bp, Homo sapiens; identical to SEQ ID NO: 797

SEQ ID NO: 2142 - DNA, 60 bp, Homo sapiens
ctagggatctaattaaggacattaaagtacaattcttgagctactaaccatcagctcttc

SEQ ID NO: 2143 - DNA, 60 bp, Homo sapiens; identical to SEQ ID NO: 1379

SEQ ID NO: 2144 - DNA, 60 bp, Homo sapiens; identical to SEQ ID NO: 1380

SEQ ID NO: 2145 - DNA, 60 bp, Homo sapiens; identical to SEQ ID NO: 1382

SEQ ID NO: 2146 - DNA, 60 bp, Homo sapiens
tcatatgccttagcagagtaagtcatttttccattttacttaggaataagctttttcgaa

SEQ ID NO: 2147 - DNA, 60 bp, Homo sapiens; identical to SEQ ID NO: 1383

SEQ ID NO: 2148 - DNA, 60 bp, Homo sapiens; identical to SEQ ID NO: 1384

SEQ ID NO: 2149 - DNA, 60 bp, Homo sapiens; identical to SEQ ID NO: 1385

SEQ ID NO: 2150 - DNA, 60 bp, Homo sapiens; identical to SEQ ID NO: 1387

SEQ ID NO: 2151 - DNA, 60 bp, Homo sapiens; identical to SEQ ID NO: 1388

SEQ ID NO: 2152 - DNA, 60 bp, Homo sapiens
ggccacatatatgctaatctataagaaaggtgatattgcagacatcaagggaaggggtac

SEQ ID NO: 2153 - DNA, 60 bp, Homo sapiens
tgttcaaaaaagaatgccccaagtgttaccatggctaaatggaagagtctgcagtgttcc

SEQ ID NO: 2154 - DNA, 60 bp, Homo sapiens; identical to SEQ ID NO: 804

SEQ ID NO: 2155 - DNA, 60 bp, Homo sapiens
atgtgatgggtgtagtcattagcaaagcatttaaatcacttgagtattttgtcatggttc

SEQ ID NO: 2156 - DNA, 60 bp, Homo sapiens; identical to SEQ ID NO: 1391

SEQ ID NO: 2157 - DNA, 60 bp, Homo sapiens; identical to SEQ ID NO: 1393

SEQ ID NO: 2158 - DNA, 60 bp, Homo sapiens; identical to SEQ ID NO: 1394

SEQ ID NO: 2159 - DNA, 60 bp, Homo sapiens; identical to SEQ ID NO: 1395

SEQ ID NO: 2160 - DNA, 60 bp, Homo sapiens; identical to SEQ ID NO: 1396

SEQ ID NO: 2161 - DNA, 60 bp, Homo sapiens; identical to SEQ ID NO: 1397

SEQ ID NO: 2162 - DNA, 60 bp, Homo sapiens; identical to SEQ ID NO: 1398

SEQ ID NO: 2163 - DNA, 60 bp, Homo sapiens
ttttttaatcagatttttgcacactgattagtttttgtgttgtggcttttgttgctttat

SEQ ID NO: 2164 - DNA, 60 bp, Homo sapiens
gaaaccttatatttgtgagaaatgtgggagggccttcattcacgatttaaagcttcagaa

SEQ ID NO: 2165 - DNA, 60 bp, Homo sapiens
gaatgaaaagagttacagaccaacttaaacatcaattcgtgtcagtaaactgacttttgg

SEQ ID NO: 2166 - DNA, 60 bp, Homo sapiens; identical to SEQ ID NO: 1399

SEQ ID NO: 2167 - DNA, 60 bp, Homo sapiens
taaaatagttgcattcggttaatttttacacattagtgcattgcgtatatcaactggccc

SEQ ID NO: 2168 - DNA, 60 bp, Homo sapiens; identical to SEQ ID NO: 1400

SEQ ID NO: 2169 - DNA, 60 bp, Homo sapiens; identical to SEQ ID NO: 1402

SEQ ID NO: 2170 - DNA, 60 bp, Homo sapiens; identical to SEQ ID NO: 1403

SEQ ID NO: 2171 - DNA, 60 bp, Homo sapiens
atggttaaaaatgcagagagcaatgcagaacttaagggtttagatgtagattctctggtc

SEQ ID NO: 2172 - DNA, 60 bp, Homo sapiens; identical to SEQ ID NO: 805

SEQ ID NO: 2173 - DNA, 60 bp, Homo sapiens; identical to SEQ ID NO: 1404

SEQ ID NO: 2174 - DNA, 60 bp, Homo sapiens
atgcatctggtgaagtggattcagaggggtaagataccagtaagaggtatctccatcaag

SEQ ID NO: 2175 - DNA, 60 bp, Homo sapiens; identical to SEQ ID NO: 1405

SEQ ID NO: 2176 - DNA, 60 bp, Homo sapiens; identical to SEQ ID NO: 1406

SEQ ID NO: 2177 - DNA, 60 bp, Homo sapiens; identical to SEQ ID NO: 1407

SEQ ID NO: 2178 - DNA, 60 bp, Homo sapiens; identical to SEQ ID NO: 1408

SEQ ID NO: 2179 - DNA, 60 bp, Homo sapiens; identical to SEQ ID NO: 1410

SEQ ID NO: 2180 - DNA, 60 bp, Homo sapiens
gtctgttctgtgttggttttcctaaaaacaatgtaacaatccgaaaaaccttttatgctc

SEQ ID NO: 2181 - DNA, 60 bp, Homo sapiens; identical to SEQ ID NO: 807

SEQ ID NO: 2182 - DNA, 60 bp, Homo sapiens; identical to SEQ ID NO: 1412

SEQ ID NO: 2183 - DNA, 60 bp, Homo sapiens; identical to SEQ ID NO: 1414

SEQ ID NO: 2184 - DNA, 60 bp, Homo sapiens; identical to SEQ ID NO: 1415

SEQ ID NO: 2185 - DNA, 60 bp, Homo sapiens; identical to SEQ ID NO: 1416

SEQ ID NO: 2186 - DNA, 60 bp, Homo sapiens; identical to SEQ ID NO: 809

SEQ ID NO: 2187 - DNA, 60 bp, Homo sapiens; identical to SEQ ID NO: 1418

SEQ ID NO: 2188 - DNA, 60 bp, Homo sapiens; identical to SEQ ID NO: 1419

SEQ ID NO: 2189 - DNA, 60 bp, Homo sapiens; identical to SEQ ID NO: 1420

SEQ ID NO: 2190 - DNA, 60 bp, Homo sapiens; identical to SEQ ID NO: 811

SEQ ID NO: 2191 - DNA, 60 bp, Homo sapiens; identical to SEQ ID NO: 1421

SEQ ID NO: 2192 - DNA, 60 bp, Homo sapiens; identical to SEQ ID NO: 1422

SEQ ID NO: 2193 - DNA, 60 bp, Homo sapiens; identical to SEQ ID NO: 1423

SEQ ID NO: 2194 - DNA, 60 bp, Homo sapiens; identical to SEQ ID NO: 812

SEQ ID NO: 2195 - DNA, 60 bp, Homo sapiens; identical to SEQ ID NO: 1425

SEQ ID NO: 2196 - DNA, 60 bp, Homo sapiens; identical to SEQ ID NO: 1426

SEQ ID NO: 2197 - DNA, 60 bp, Homo sapiens; identical to SEQ ID NO: 1428

SEQ ID NO: 2198 - DNA, 60 bp, Homo sapiens; identical to SEQ ID NO: 1430

SEQ ID NO: 2199 - DNA, 60 bp, Homo sapiens; identical to SEQ ID NO: 1431

SEQ ID NO: 2200 - DNA, 60 bp, Homo sapiens; identical to SEQ ID NO: 1432

SEQ ID NO: 2201 - DNA, 60 bp, Homo sapiens; identical to SEQ ID NO: 1433

SEQ ID NO: 2202 - DNA, 60 bp, Homo sapiens; identical to SEQ ID NO: 1434

SEQ ID NO: 2203 - DNA, 60 bp, Homo sapiens; identical to SEQ ID NO: 1435

SEQ ID NO: 2204 - DNA, 60 bp, Homo sapiens; identical to SEQ ID NO: 816

SEQ ID NO: 2205 - DNA, 60 bp, Homo sapiens; identical to SEQ ID NO: 1438

SEQ ID NO: 2206 - DNA, 60 bp, Homo sapiens; identical to SEQ ID NO: 1439

SEQ ID NO: 2207 - DNA, 60 bp, Homo sapiens; identical to SEQ ID NO: 1440

SEQ ID NO: 2208 - DNA, 60 bp, Homo sapiens; identical to SEQ ID NO: 1441

SEQ ID NO: 2209 - DNA, 60 bp, Homo sapiens; identical to SEQ ID NO: 1442

SEQ ID NO: 2210 - DNA, 60 bp, Homo sapiens
ggctgaactacaagtgtaggccaccattataatttataaatacagcatacttcaaaactg

SEQ ID NO: 2211 - DNA, 60 bp, Homo sapiens; identical to SEQ ID NO: 1444

SEQ ID NO: 2212 - DNA, 60 bp, Homo sapiens; identical to SEQ ID NO: 1445

SEQ ID NO: 2213 - DNA, 60 bp, Homo sapiens
ctacatatttaccttgaatgttacaattagcttgccaataaatattagtagctcttaagc

SEQ ID NO: 2214 - DNA, 60 bp, Homo sapiens
tgcttgttcgtatctcagcccgaagatgattatccttgaggaatgacattgagcttgttt

SEQ ID NO: 2215 - DNA, 60 bp, Homo sapiens
agtcataccgcagaaaagatggcgtgtttctttattttgaagataatgcaggggtcacag

SEQ ID NO: 2216 - DNA, 60 bp, Homo sapiens; identical to SEQ ID NO: 1447

SEQ ID NO: 2217 - DNA, 60 bp, Homo sapiens; identical to SEQ ID NO: 1448

SEQ ID NO: 2218 - DNA, 60 bp, Homo sapiens; identical to SEQ ID NO: 1450

SEQ ID NO: 2219 - DNA, 60 bp, Homo sapiens; identical to SEQ ID NO: 821

SEQ ID NO: 2220 - DNA, 60 bp, Homo sapiens; identical to SEQ ID NO: 1453

SEQ ID NO: 2221 - DNA, 60 bp, Homo sapiens
tgtattcacttatgctctcgtacattgagtacttttattccaaaactagtgggttttctc

SEQ ID NO: 2222 - DNA, 60 bp, Homo sapiens; identical to SEQ ID NO: 1454

SEQ ID NO: 2223 - DNA, 60 bp, Homo sapiens; identical to SEQ ID NO: 1455

SEQ ID NO: 2224 - DNA, 60 bp, Homo sapiens
ttcctaaaattcactggactttctctaagaagtgtggcaagcatcaaccccacaaagtga

SEQ ID NO: 2225 - DNA, 60 bp, Homo sapiens; identical to SEQ ID NO: 1456

SEQ ID NO: 2226 - DNA, 60 bp, Homo sapiens; identical to SEQ ID NO: 1457

SEQ ID NO: 2227 - DNA, 60 bp, Homo sapiens; identical to SEQ ID NO: 1459

SEQ ID NO: 2228 - DNA, 60 bp, Homo sapiens
tacctaacggtggctgccattttcaggggtcgcatgcccatgagggaggtggatgaacaa

SEQ ID NO: 2229 - DNA, 60 bp, Homo sapiens; identical to SEQ ID NO: 826

SEQ ID NO: 2230 - DNA, 60 bp, Homo sapiens
ctgttcctttggcgacgtatatgcgaatctataagaaaggtgatattgtagacatcaagg

SEQ ID NO: 2231 - DNA, 60 bp, Homo sapiens; identical to SEQ ID NO: 1464

SEQ ID NO: 2232 - DNA, 60 bp, Homo sapiens; identical to SEQ ID NO: 1465

SEQ ID NO: 2233 - DNA, 60 bp, Homo sapiens; identical to SEQ ID NO: 1466

SEQ ID NO: 2234 - DNA, 60 bp, Homo sapiens; identical to SEQ ID NO: 1469

SEQ ID NO: 2235 - DNA, 60 bp, Homo sapiens
acataccttcaactgcagaactcagttttatgacaccttgaataaaaacaaaagtggcag

SEQ ID NO: 2236 - DNA, 60 bp, Homo sapiens; identical to SEQ ID NO: 1470

SEQ ID NO: 2237 - DNA, 60 bp, Homo sapiens; identical to SEQ ID NO: 1471

SEQ ID NO: 2238 - DNA, 60 bp, Homo sapiens
ggacaagaagctgccaggcataataggaagataccagaattgctgttaacaaataaaata

SEQ ID NO: 2239 - DNA, 60 bp, Homo sapiens; identical to SEQ ID NO: 1472

SEQ ID NO: 2240 - DNA, 60 bp, Homo sapiens; identical to SEQ ID NO: 1473

SEQ ID NO: 2241 - DNA, 60 bp, Homo sapiens
cgtaccctgttactaccacagttggtctgttttatcctgtaagtaccaaatatgaatggc

SEQ ID NO: 2242 - DNA, 60 bp, Homo sapiens; identical to SEQ ID NO: 1474

SEQ ID NO: 2243 - DNA, 60 bp, Homo sapiens; identical to SEQ ID NO: 1475

SEQ ID NO: 2244 - DNA, 60 bp, Homo sapiens; identical to SEQ ID NO: 1476

SEQ ID NO: 2245 - DNA, 60 bp, Homo sapiens; identical to SEQ ID NO: 1477

SEQ ID NO: 2246 - DNA, 60 bp, Homo sapiens; identical to SEQ ID NO: 1479

SEQ ID NO: 2247 - DNA, 60 bp, Homo sapiens; identical to SEQ ID NO: 1480

SEQ ID NO: 2248 - DNA, 60 bp, Homo sapiens; identical to SEQ ID NO: 830

SEQ ID NO: 2249 - DNA, 60 bp, Homo sapiens
acatggggcttacaagtgcttcttgtccaagtagtctaccaatgaaaagagaaattacag

SEQ ID NO: 2250 - DNA, 60 bp, Homo sapiens; identical to SEQ ID NO: 1484

SEQ ID NO: 2251 - DNA, 60 bp, Homo sapiens; identical to SEQ ID NO: 833

SEQ ID NO: 2252 - DNA, 60 bp, Homo sapiens; identical to SEQ ID NO: 1487

SEQ ID NO: 2253 - DNA, 60 bp, Homo sapiens; identical to SEQ ID NO: 1488

SEQ ID NO: 2254 - DNA, 60 bp, Homo sapiens; identical to SEQ ID NO: 1489

SEQ ID NO: 2255 - DNA, 60 bp, Homo sapiens
tcttgtgcacccaagatctgctctctgttgtaaatcctgttcagacctggtctaattggt

SEQ ID NO: 2256 - DNA, 60 bp, Homo sapiens
aaagatatatcagccaacactgcaactgctcaccatgaatttttggtttgttcataagaa

SEQ ID NO: 2257 - DNA, 60 bp, Homo sapiens
tgtggtttggtattccaagtggggtctttttcagaatctctgcactagtgtgagatgcaa

SEQ ID NO: 2258 - DNA, 60 bp, Homo sapiens; identical to SEQ ID NO: 1491

SEQ ID NO: 2259 - DNA, 60 bp, Homo sapiens; identical to SEQ ID NO: 1492

SEQ ID NO: 2260 - DNA, 60 bp, Homo sapiens
atgttctctaggccttttagaaaacatggaggaatgggtactgttcaaaaaggaatgccc

SEQ ID NO: 2261 - DNA, 60 bp, Homo sapiens; identical to SEQ ID NO: 1493

SEQ ID NO: 2262 - DNA, 60 bp, Homo sapiens; identical to SEQ ID NO: 1494

SEQ ID NO: 2263 - DNA, 60 bp, Homo sapiens; identical to SEQ ID NO: 1495

SEQ ID NO: 2264 - DNA, 60 bp, Homo sapiens; identical to SEQ ID NO: 1496

SEQ ID NO: 2265 - DNA, 60 bp, Homo sapiens; identical to SEQ ID NO: 1497

SEQ ID NO: 2266 - DNA, 60 bp, Homo sapiens; identical to SEQ ID NO: 1500

SEQ ID NO: 2267 - DNA, 60 bp, Homo sapiens; identical to SEQ ID NO: 1501

SEQ ID NO: 2268 - DNA, 60 bp, Homo sapiens; identical to SEQ ID NO: 1502

SEQ ID NO: 2269 - DNA, 60 bp, Homo sapiens; identical to SEQ ID NO: 1504

SEQ ID NO: 2270 - DNA, 60 bp, Homo sapiens; identical to SEQ ID NO: 1505

SEQ ID NO: 2271 - DNA, 60 bp, Homo sapiens; identical to SEQ ID NO: 1506

SEQ ID NO: 2272 - DNA, 60 bp, Homo sapiens; identical to SEQ ID NO: 837

SEQ ID NO: 2273 - DNA, 60 bp, Homo sapiens; identical to SEQ ID NO: 1508

SEQ ID NO: 2274 - DNA, 60 bp, Homo sapiens; identical to SEQ ID NO: 1509

SEQ ID NO: 2275 - DNA, 60 bp, Homo sapiens
tggcaaccatcctaagaaagaacggaaacccaagggaacagatgtctacataggactgta

SEQ ID NO: 2276 - DNA, 60 bp, Homo sapiens; identical to SEQ ID NO: 839

SEQ ID NO: 2277 - DNA, 60 bp, Homo sapiens; identical to SEQ ID NO: 1511

SEQ ID NO: 2278 - DNA, 60 bp, Homo sapiens; identical to SEQ ID NO: 1512

SEQ ID NO: 2279 - DNA, 60 bp, Homo sapiens; identical to SEQ ID NO: 1513

SEQ ID NO: 2280 - DNA, 60 bp, Homo sapiens; identical to SEQ ID NO: 1514

SEQ ID NO: 2281 - DNA, 60 bp, Homo sapiens; identical to SEQ ID NO: 1515

SEQ ID NO: 2282 - DNA, 60 bp, Homo sapiens; identical to SEQ ID NO: 1516

SEQ ID NO: 2283 - DNA, 60 bp, Homo sapiens
tacgtgatagtataaaccaatgtgacttcatgtgatcatatccaggatttttattcgtcg

SEQ ID NO: 2284 - DNA, 60 bp, Homo sapiens; identical to SEQ ID NO: 841

SEQ ID NO: 2285 - DNA, 60 bp, Homo sapiens; identical to SEQ ID NO: 843

SEQ ID NO: 2286 - DNA, 60 bp, Homo sapiens; identical to SEQ ID NO: 1519

SEQ ID NO: 2287 - DNA, 60 bp, Homo sapiens
acattgaaatatgttttgtataaatttgtcatgttgaacaacattttagcatggtaagtt

SEQ ID NO: 2288 - DNA, 60 bp, Homo sapiens; identical to SEQ ID NO: 1520

SEQ ID NO: 2289 - DNA, 60 bp, Homo sapiens; identical to SEQ ID NO: 1521

SEQ ID NO: 2290 - DNA, 60 bp, Homo sapiens; identical to SEQ ID NO: 1522

SEQ ID NO: 2291 - DNA, 60 bp, Homo sapiens; identical to SEQ ID NO: 846

SEQ ID NO: 2292 - DNA, 60 bp, Homo sapiens; identical to SEQ ID NO: 1524

SEQ ID NO: 2293 - DNA, 60 bp, Homo sapiens; identical to SEQ ID NO: 847

SEQ ID NO: 2294 - DNA, 60 bp, Homo sapiens; identical to SEQ ID NO: 1525

SEQ ID NO: 2295 - DNA, 60 bp, Homo sapiens
tttgactgagtatttgtagatgcttaatgactgaaatgaatttggaggcactgatgaaag

SEQ ID NO: 2296 - DNA, 60 bp, Homo sapiens
ttgccagcattttttgaagtaatacactgctgctacctggaagatgtctaacttcatttt

SEQ ID NO: 2297 - DNA, 60 bp, Homo sapiens; identical to SEQ ID NO: 1528

SEQ ID NO: 2298 - DNA, 60 bp, Homo sapiens; identical to SEQ ID NO: 1529

SEQ ID NO: 2299 - DNA, 60 bp, Homo sapiens; identical to SEQ ID NO: 1530

SEQ ID NO: 2300 - DNA, 60 bp, Homo sapiens; identical to SEQ ID NO: 1531

SEQ ID NO: 2301 - DNA, 60 bp, Homo sapiens
tagtgctgtagtgcttgtttatgtttaaaagtgcacattatgcagctcattttagtatgc

SEQ ID NO: 2302 - DNA, 60 bp, Homo sapiens; identical to SEQ ID NO: 1532

SEQ ID NO: 2303 - DNA, 60 bp, Homo sapiens
gaacacaaagagaaagaggaggggcacccgatatatgttctttaggccttttagaaaaca

SEQ ID NO: 2304 - DNA, 60 bp, Homo sapiens; identical to SEQ ID NO: 848

SEQ ID NO: 2305 - DNA, 60 bp, Homo sapiens
atattaagatagttgcaggcagtgtacctcaggttgactctgtacatctgaatagtgagt

SEQ ID NO: 2306 - DNA, 60 bp, Homo sapiens; identical to SEQ ID NO: 1534

SEQ ID NO: 2307 - DNA, 60 bp, Homo sapiens; identical to SEQ ID NO: 1535

SEQ ID NO: 2308 - DNA, 60 bp, Homo sapiens; identical to SEQ ID NO: 1536

SEQ ID NO: 2309 - DNA, 60 bp, Homo sapiens; identical to SEQ ID NO: 1537

SEQ ID NO: 2310 - DNA, 60 bp, Homo sapiens
ctttggccacgtgtatgtgaatctataagaaaggtgatattgtagacatcaagggaatgg

SEQ ID NO: 2311 - DNA, 60 bp, Homo sapiens; identical to SEQ ID NO: 1538

SEQ ID NO: 2312 - DNA, 60 bp, Homo sapiens; identical to SEQ ID NO: 1539

SEQ ID NO: 2313 - DNA, 60 bp, Homo sapiens; identical to SEQ ID NO: 1540

SEQ ID NO: 2314 - DNA, 60 bp, Homo sapiens; identical to SEQ ID NO: 850

SEQ ID NO: 2315 - DNA, 60 bp, Homo sapiens; identical to SEQ ID NO: 851

SEQ ID NO: 2316 - DNA, 60 bp, Homo sapiens; identical to SEQ ID NO: 853

SEQ ID NO: 2317 - DNA, 60 bp, Homo sapiens; identical to SEQ ID NO: 1544

SEQ ID NO: 2318 - DNA, 60 bp, Homo sapiens; identical to SEQ ID NO: 1545

SEQ ID NO: 2319 - DNA, 60 bp, Homo sapiens
agaggcacccgatatatgttctctaggccttttagaaaacatgggaacgggtactgttca

SEQ ID NO: 2320 - DNA, 60 bp, Homo sapiens; identical to SEQ ID NO: 1546

SEQ ID NO: 2321 - DNA, 60 bp, Homo sapiens; identical to SEQ ID NO: 1547

SEQ ID NO: 2322 - DNA, 60 bp, Homo sapiens; identical to SEQ ID NO: 855

SEQ ID NO: 2323 - DNA, 60 bp, Homo sapiens; identical to SEQ ID NO: 1549

SEQ ID NO: 2324 - DNA, 60 bp, Homo sapiens; identical to SEQ ID NO: 1550

SEQ ID NO: 2325 - DNA, 60 bp, Homo sapiens; identical to SEQ ID NO: 856

SEQ ID NO: 2326 - DNA, 60 bp, Homo sapiens; identical to SEQ ID NO: 857

SEQ ID NO: 2327 - DNA, 60 bp, Homo sapiens; identical to SEQ ID NO: 1556

SEQ ID NO: 2328 - DNA, 60 bp, Homo sapiens; identical to SEQ ID NO: 1557

SEQ ID NO: 2329 - DNA, 60 bp, Homo sapiens
gtgatacccaagaaacatatatcccagatttctgtggcagaagatgatgatgaaagtctt

SEQ ID NO: 2330 - DNA, 60 bp, Homo sapiens
ctattcaaacacagatgcagtcatttatgtagtagacagttgtgaccgagaccgaattgg

SEQ ID NO: 2331 - DNA, 60 bp, Homo sapiens; identical to SEQ ID NO: 861

SEQ ID NO: 2332 - DNA, 60 bp, Homo sapiens; identical to SEQ ID NO: 1560

SEQ ID NO: 2333 - DNA, 60 bp, Homo sapiens; identical to SEQ ID NO: 1562

SEQ ID NO: 2334 - DNA, 60 bp, Homo sapiens; identical to SEQ ID NO: 1563

SEQ ID NO: 2335 - DNA, 60 bp, Homo sapiens; identical to SEQ ID NO: 1565

SEQ ID NO: 2336 - DNA, 60 bp, Homo sapiens; identical to SEQ ID NO: 1566

SEQ ID NO: 2337 - DNA, 60 bp, Homo sapiens; identical to SEQ ID NO: 1567

SEQ ID NO: 2338 - DNA, 60 bp, Homo sapiens; identical to SEQ ID NO: 1569

SEQ ID NO: 2339 - DNA, 60 bp, Homo sapiens; identical to SEQ ID NO: 1570

SEQ ID NO: 2340 - DNA, 60 bp, Homo sapiens; identical to SEQ ID NO: 864

SEQ ID NO: 2341 - DNA, 60 bp, Homo sapiens
aaatgtgaagtctggctttgaagagggtgtataacacacataatttactgtgcatcagtc

SEQ ID NO: 2342 - DNA, 60 bp, Homo sapiens; identical to SEQ ID NO: 865

SEQ ID NO: 2343 - DNA, 60 bp, Homo sapiens; identical to SEQ ID NO: 1573

SEQ ID NO: 2344 - DNA, 60 bp, Homo sapiens; identical to SEQ ID NO: 1574

SEQ ID NO: 2345 - DNA, 60 bp, Homo sapiens; identical to SEQ ID NO: 1575

SEQ ID NO: 2346 - DNA, 60 bp, Homo sapiens; identical to SEQ ID NO: 1576

SEQ ID NO: 2347 - DNA, 60 bp, Homo sapiens; identical to SEQ ID NO: 1578

SEQ ID NO: 2348 - DNA, 60 bp, Homo sapiens; identical to SEQ ID NO: 1579

SEQ ID NO: 2349 - DNA, 60 bp, Homo sapiens
ataactgcttcatttgctgggaaccattacaagtagtataaattagctttttccagaagg

SEQ ID NO: 2350 - DNA, 60 bp, Homo sapiens; identical to SEQ ID NO: 1580

SEQ ID NO: 2351 - DNA, 60 bp, Homo sapiens
gagcctgacaaatgttctggatgtaacagtatgaacacctatgagctgggactacttctg

SEQ ID NO: 2352 - DNA, 60 bp, Homo sapiens; identical to SEQ ID NO: 1581

SEQ ID NO: 2353 - DNA, 60 bp, Homo sapiens
caaaaggactgcggcctgatgcatgctggaaaaagacacgcttttcatttctgatcagtt

SEQ ID NO: 2354 - DNA, 60 bp, Homo sapiens
cagcctcagttgtcacgtggactcttgatgcccaattattgcctcaatccagaaaagttt

SEQ ID NO: 2355 - DNA, 60 bp, Homo sapiens
cgtcctcagtcctgagttgtgacatctccagaaataacaaatacattgtgacaggctcgg

SEQ ID NO: 2356 - DNA, 60 bp, Homo sapiens; identical to SEQ ID NO: 1589

SEQ ID NO: 2357 - DNA, 60 bp, Homo sapiens
ggaggctgtggatgatgctttcaagacaatggatgtggatatggccgaggaacatgccag

SEQ ID NO: 2358 - DNA, 60 bp, Homo sapiens; identical to SEQ ID NO: 100

SEQ ID NO: 2359 - DNA, 60 bp, Homo sapiens
tgcccctcgatatctcctctactaccgctcggaggaggatcaccaccggcctgctgacat

SEQ ID NO: 2360 - DNA, 60 bp, Homo sapiens
aatgcagagggaacaccagaggacgtttttcttcaactctgcacagctattgactctatt

SEQ ID NO: 2361 - DNA, 60 bp, Homo sapiens; identical to SEQ ID NO: 1593

SEQ ID NO: 2362 - DNA, 60 bp, Homo sapiens
tgctgacaaacattctctttgccatgaaggaggataatgagaaggtgcctactttgctaa

SEQ ID NO: 2363 - DNA, 60 bp, Homo sapiens; identical to SEQ ID NO: 1594

SEQ ID NO: 2364 - DNA, 60 bp, Homo sapiens; identical to SEQ ID NO: 131

SEQ ID NO: 2365 - DNA, 60 bp, Homo sapiens; identical to SEQ ID NO: 1596

SEQ ID NO: 2366 - DNA, 60 bp, Homo sapiens
cagagttcttggaggattctgaggtagagagtagcataatctcatttgtgtttttattct

SEQ ID NO: 2367 - DNA, 60 bp, Homo sapiens; identical to SEQ ID NO: 1597

SEQ ID NO: 2368 - DNA, 60 bp, Homo sapiens
ccctctgtacctctcataactggtcaacgactgtaacaggttacatcaggtgtttttcta

SEQ ID NO: 2369 - DNA, 60 bp, Homo sapiens; identical to SEQ ID NO: 168

SEQ ID NO: 2370 - DNA, 60 bp, Homo sapiens; identical to SEQ ID NO: 170

SEQ ID NO: 2371 - DNA, 60 bp, Homo sapiens; identical to SEQ ID NO: 179

SEQ ID NO: 2372 - DNA, 60 bp, Homo sapiens
gttcctttgcggggaaaattgcactaaaacagaaccttttcttaatccatgttggaagga

SEQ ID NO: 2373 - DNA, 60 bp, Homo sapiens; identical to SEQ ID NO: 1601

SEQ ID NO: 2374 - DNA, 60 bp, Homo sapiens; identical to SEQ ID NO: 1602

SEQ ID NO: 2375 - DNA, 60 bp, Homo sapiens; identical to SEQ ID NO: 876

SEQ ID NO: 2376 - DNA, 60 bp, Homo sapiens
acccaaattctaggatagctctgaagcctgctggaaacttggtggcatccaacctgcctc

SEQ ID NO: 2377 - DNA, 60 bp, Homo sapiens
gggctagctgaagcccattggtttccacgatttcaattggctgagaaggcagagagctag

SEQ ID NO: 2378 - DNA, 60 bp, Homo sapiens
ctgctcaacatccggagggaattcattgagaaatatgacaagtctctccaccaagccatt

SEQ ID NO: 2379 - DNA, 60 bp, Homo sapiens
tttcccccctttatagatggtcacgcacctgggtgttacaaagttgtatgtggcatgaat

SEQ ID NO: 2380 - DNA, 60 bp, Homo sapiens; identical to SEQ ID NO: 878

SEQ ID NO: 2381 - DNA, 60 bp, Homo sapiens; identical to SEQ ID NO: 196

SEQ ID NO: 2382 - DNA, 60 bp, Homo sapiens
cctgtccaaggttccctcttgtcagatctgagatttcctagttatgtctggggccctctg

SEQ ID NO: 2383 - DNA, 60 bp, Homo sapiens
gaccggttacttgggaaggggtcctggcctgaagacagtgtgtgcggcaagaacgcaagg

SEQ ID NO: 2384 - DNA, 60 bp, Homo sapiens
gttagcatttcctcctgaagtgttctgttggcaataaaatgcactttgactgtttgttgt

SEQ ID NO: 2385 - DNA, 60 bp, Homo sapiens; identical to SEQ ID NO: 220

SEQ ID NO: 2386 - DNA, 60 bp, Homo sapiens; identical to SEQ ID NO: 222

SEQ ID NO: 2387 - DNA, 60 bp, Homo sapiens; identical to SEQ ID NO: 1608

SEQ ID NO: 2388 - DNA, 60 bp, Homo sapiens; identical to SEQ ID NO: 1609

SEQ ID NO: 2389 - DNA, 60 bp, Homo sapiens
catctgccaggaaggttgaggactcccaggtttcacccactggaggctcaacctaaggaa

SEQ ID NO: 2390 - DNA, 60 bp, Homo sapiens; identical to SEQ ID NO: 249

SEQ ID NO: 2391 - DNA, 60 bp, Homo sapiens; identical to SEQ ID NO: 1613

SEQ ID NO: 2392 - DNA, 60 bp, Homo sapiens
ctgacaaccctgatcatcatggacgtacagaaacaagatggtggactttataccctgagt

SEQ ID NO: 2393 - DNA, 60 bp, Homo sapiens; identical to SEQ ID NO: 882

SEQ ID NO: 2394 - DNA, 60 bp, Homo sapiens; identical to SEQ ID NO: 300

SEQ ID NO: 2395 - DNA, 60 bp, Homo sapiens
tgctcctacccaggagagctccctatccgcctttggtcagagctgaagccatatacgact

SEQ ID NO: 2396 - DNA, 60 bp, Homo sapiens
cctgagcctcaactcttcagaaaatagtgtttttaatattcctcttcagaaaatagtgtt

SEQ ID NO: 2397 - DNA, 60 bp, Homo sapiens; identical to SEQ ID NO: 351

SEQ ID NO: 2398 - DNA, 60 bp, Homo sapiens
aattggagaattgaataatcagcatatgtaagcgcactagaaccctgtgttgaaaactgc

SEQ ID NO: 2399 - DNA, 60 bp, Homo sapiens; identical to SEQ ID NO: 353

SEQ ID NO: 2400 - DNA, 60 bp, Homo sapiens
agatggtgcagtggttagagctgaggcttatcccacagagaaccctggcgccttggtcaa

SEQ ID NO: 2401 - DNA, 60 bp, Homo sapiens
tctgcctccaaatctgaacagtcactgtaaatcattcttaagcccagatatgagaacttc

SEQ ID NO: 2402 - DNA, 60 bp, Homo sapiens; identical to SEQ ID NO: 1624

SEQ ID NO: 2403 - DNA, 60 bp, Homo sapiens
tcccccctcatctgttgggtgaaatactgtttatcctttagtactaaaattaaaagttac

SEQ ID NO: 2404 - DNA, 60 bp, Homo sapiens; identical to SEQ ID NO: 1625

SEQ ID NO: 2405 - DNA, 60 bp, Homo sapiens
acccccctcactttttcagacctatagttgtcctttttgattctccagttaaaactacaa

SEQ ID NO: 2406 - DNA, 60 bp, Homo sapiens
ggtgatgacacaactctattggggattggcaccttctcaaccttcctatcaaatattctt

SEQ ID NO: 2407 - DNA, 60 bp, Homo sapiens
agcattttagactaggactgttctactgtgaagaaagttctgtctcctttagcccggttt

SEQ ID NO: 2408 - DNA, 60 bp, Homo sapiens; identical to SEQ ID NO: 1631

SEQ ID NO: 2409 - DNA, 60 bp, Homo sapiens
ctccgtacatgaaagtaagcctgaagactcaggtctcgtctctcattttctgaagatttt

SEQ ID NO: 2410 - DNA, 60 bp, Homo sapiens; identical to SEQ ID NO: 433

SEQ ID NO: 2411 - DNA, 60 bp, Homo sapiens
aagaaaaagcagcctccaccaccagaatcaggtctagagcggaagctggagtggtggcct

SEQ ID NO: 2412 - DNA, 60 bp, Homo sapiens; identical to SEQ ID NO: 438

SEQ ID NO: 2413 - DNA, 60 bp, Homo sapiens; identical to SEQ ID NO: 1644

SEQ ID NO: 2414 - DNA, 60 bp, Homo sapiens
gcgagccagcggcgacgaatgaagaactttttcacttactgcaggattttcagcttcagc

SEQ ID NO: 2415 - DNA, 60 bp, Homo sapiens
agacaagcttttaccgacttcctctgcttgccagcaaagtcatctgctaactggatattg

SEQ ID NO: 2416 - DNA, 60 bp, Homo sapiens
tcctgcatagtctatctttgtatatctttgaacttttcaagaataaaaaagcttaaaaag

SEQ ID NO: 2417 - DNA, 60 bp, Homo sapiens
atccagttttgtcgatccaattgagaaaacatttcatgaacaactacttgtggcatgcat

SEQ ID NO: 2418 - DNA, 60 bp, Homo sapiens; identical to SEQ ID NO: 457

SEQ ID NO: 2419 - DNA, 60 bp, Homo sapiens; identical to SEQ ID NO: 466

SEQ ID NO: 2420 - DNA, 60 bp, Homo sapiens; identical to SEQ ID NO: 469

SEQ ID NO: 2421 - DNA, 60 bp, Homo sapiens
aagggcctcagatgtactggtttccacagaaccattgttaggcttttgtgaagcattttt

SEQ ID NO: 2422 - DNA, 60 bp, Homo sapiens
ggtccccgtccctctctgtaaccaataaccaatgccatataaatggaaaagtataaagaa

SEQ ID NO: 2423 - DNA, 60 bp, Homo sapiens
aggtctgatgcagtagcttttactattggtggaaatcgatgttttttccttgaaagtcta

SEQ ID NO: 2424 - DNA, 60 bp, Homo sapiens; identical to SEQ ID NO: 473

SEQ ID NO: 2425 - DNA, 60 bp, Homo sapiens
tgatctccaaggttctgacctctgagagtgacgttaagtccagagagccacaccactaca

SEQ ID NO: 2426 - DNA, 60 bp, Homo sapiens
gaaagaacatgaaaagcattggaatcaaggaaagccacctggttttagactttaattttg

SEQ ID NO: 2427 - DNA, 60 bp, Homo sapiens; identical to SEQ ID NO: 483

SEQ ID NO: 2428 - DNA, 60 bp, Homo sapiens
gatagggtctgagggacagaaaagcagcatagtcccaatttagtttctcaaaacacatag

SEQ ID NO: 2429 - DNA, 60 bp, Homo sapiens
ctgtttggccacgactgattgcagcccctggtgaaatgagaaccctgtgggtcggaacaa

SEQ ID NO: 2430 - DNA, 60 bp, Homo sapiens; identical to SEQ ID NO: 1670

SEQ ID NO: 2431 - DNA, 60 bp, Homo sapiens; identical to SEQ ID NO: 493

SEQ ID NO: 2432 - DNA, 60 bp, Homo sapiens
tcaataggttttatttgctccggtttacctagatgaaaaattgagacccagaatccatgc

SEQ ID NO: 2433 - DNA, 60 bp, Homo sapiens; identical to SEQ ID NO: 498

SEQ ID NO: 2434 - DNA, 60 bp, Homo sapiens; identical to SEQ ID NO: 506

SEQ ID NO: 2435 - DNA, 60 bp, Homo sapiens
atagtgatgtgttcgacgttttatcaaaggccccctttctatgttcatgttagttttgct

SEQ ID NO: 2436 - DNA, 60 bp, Homo sapiens; identical to SEQ ID NO: 520

SEQ ID NO: 2437 - DNA, 60 bp, Homo sapiens
tggaaaggtgtttctctcatctctgtcctaaggcttgataaagtcattaaaattgtgttc

SEQ ID NO: 2438 - DNA, 60 bp, Homo sapiens; identical to SEQ ID NO: 523

SEQ ID NO: 2439 - DNA, 60 bp, Homo sapiens
gtcttgcctgaaagtattttctcagtctttgagaaaacagtggaactgactcatctggtc

SEQ ID NO: 2440 - DNA, 60 bp, Homo sapiens; identical to SEQ ID NO: 538

SEQ ID NO: 2441 - DNA, 60 bp, Homo sapiens; identical to SEQ ID NO: 541

SEQ ID NO: 2442 - DNA, 60 bp, Homo sapiens
atgccggactgagccctgagtgtttggaaaggcgagactccgcctttctaatcacaaatg

SEQ ID NO: 2443 - DNA, 60 bp, Homo sapiens; identical to SEQ ID NO: 548

SEQ ID NO: 2444 - DNA, 60 bp, Homo sapiens
tacagggattagatccgagccacattacccatatatgctcagaatggtctgtcaggaaca

SEQ ID NO: 2445 - DNA, 60 bp, Homo sapiens; identical to SEQ ID NO: 549

SEQ ID NO: 2446 - DNA, 60 bp, Homo sapiens; identical to SEQ ID NO: 550

SEQ ID NO: 2447 - DNA, 60 bp, Homo sapiens
ttcaaaggattctccaaggggtcagtgattctcaaagattaagagccactaatttaagcc

SEQ ID NO: 2448 - DNA, 60 bp, Homo sapiens; identical to SEQ ID NO: 554

SEQ ID NO: 2449 - DNA, 60 bp, Homo sapiens; identical to SEQ ID NO: 953

SEQ ID NO: 2450 - DNA, 60 bp, Homo sapiens
gggtattgtgcttagatttgaaggtaaagccatgtttctgcagaatgcattccactagta

SEQ ID NO: 2451 - DNA, 60 bp, Homo sapiens; identical to SEQ ID NO: 556

SEQ ID NO: 2452 - DNA, 60 bp, Homo sapiens
ctcatgttatcatcattagtgatctgtgttgtagaacatgagggtgtaagccttcagcct

SEQ ID NO: 2453 - DNA, 60 bp, Homo sapiens; identical to SEQ ID NO: 955

SEQ ID NO: 2454 - DNA, 60 bp, Homo sapiens
gatttccctgacccaattcagagattctttatgcaaaagtgagttcagtccatctctata

SEQ ID NO: 2455 - DNA, 60 bp, Homo sapiens
ccagtgacctcctggagattccggtctcaggagcagctgataacctcagtccgtcacaaa

SEQ ID NO: 2456 - DNA, 60 bp, Homo sapiens
attcagaaaccttgcttgtgtgatacatagtaagtctcttcatttattactgcttgtctg

SEQ ID NO: 2457 - DNA, 60 bp, Homo sapiens; identical to SEQ ID NO: 960

SEQ ID NO: 2458 - DNA, 60 bp, Homo sapiens; identical to SEQ ID NO: 961

SEQ ID NO: 2459 - DNA, 60 bp, Homo sapiens
tggaatcaggagacaaagctaccacatgtggaaaggtactatgtgtccatgtcattcaaa

SEQ ID NO: 2460 - DNA, 60 bp, Homo sapiens; identical to SEQ ID NO: 559

SEQ ID NO: 2461 - DNA, 60 bp, Homo sapiens
agtaggagtgaaagcacttcagaatttaaaccaggatactccctgcatgatacatctgtg

SEQ ID NO: 2462 - DNA, 60 bp, Homo sapiens
agaattcttaacttcacaagtgttttacttcgacgatgtgcctttgatttaatttgggac

SEQ ID NO: 2463 - DNA, 60 bp, Homo sapiens
cgtggcacagggcataagggaggaggaagtaagttaccaacttgcatttaacaaacaaga

SEQ ID NO: 2464 - DNA, 60 bp, Homo sapiens
tagatctgggattatgtggccttaggtagctggttgtacatctttccctaaatcgatcca

SEQ ID NO: 2465 - DNA, 60 bp, Homo sapiens; identical to SEQ ID NO: 966

SEQ ID NO: 2466 - DNA, 60 bp, Homo sapiens; identical to SEQ ID NO: 562

SEQ ID NO: 2467 - DNA, 60 bp, Homo sapiens
tgtgtgatggtgcaaggaatggattcaggatgttgttggagaaacaagtttgtgattagt

SEQ ID NO: 2468 - DNA, 60 bp, Homo sapiens; identical to SEQ ID NO: 970

SEQ ID NO: 2469 - DNA, 60 bp, Homo sapiens
caataagcagcattggcctggagtgccagagcgtcacctccaggggggacctggctactt

SEQ ID NO: 2470 - DNA, 60 bp, Homo sapiens; identical to SEQ ID NO: 971

SEQ ID NO: 2471 - DNA, 60 bp, Homo sapiens; identical to SEQ ID NO: 565

SEQ ID NO: 2472 - DNA, 60 bp, Homo sapiens
cttcccacccttttttcaaaggcaccacaagtatagacagttgcactacatcaaatcttt

SEQ ID NO: 2473 - DNA, 60 bp, Homo sapiens; identical to SEQ ID NO: 567

SEQ ID NO: 2474 - DNA, 60 bp, Homo sapiens; identical to SEQ ID NO: 568

SEQ ID NO: 2475 - DNA, 60 bp, Homo sapiens
tggacattcgaacagagttcaagaagcattatggctattccctatattcagcaattaaat

SEQ ID NO: 2476 - DNA, 60 bp, Homo sapiens; identical to SEQ ID NO: 976

SEQ ID NO: 2477 - DNA, 60 bp, Homo sapiens; identical to SEQ ID NO: 569

SEQ ID NO: 2478 - DNA, 60 bp, Homo sapiens; identical to SEQ ID NO: 979

SEQ ID NO: 2479 - DNA, 60 bp, Homo sapiens
aaagagcctgggtgtttgggtcagataaatgaagatcaaactccagctccagcctcattt

SEQ ID NO: 2480 - DNA, 60 bp, Homo sapiens; identical to SEQ ID NO: 570

SEQ ID NO: 2481 - DNA, 60 bp, Homo sapiens
ttgaagaggggaaattatacttattgttgtttactgaatcctggtgtgaaagcatatcag

SEQ ID NO: 2482 - DNA, 60 bp, Homo sapiens; identical to SEQ ID NO: 575

SEQ ID NO: 2483 - DNA, 60 bp, Homo sapiens; identical to SEQ ID NO: 576

SEQ ID NO: 2484 - DNA, 60 bp, Homo sapiens; identical to SEQ ID NO: 986

SEQ ID NO: 2485 - DNA, 60 bp, Homo sapiens
ttggtattgaggcgaggctgaaatctgccaaaaacagccaacatgatttgactggacctt

SEQ ID NO: 2486 - DNA, 60 bp, Homo sapiens
cacagggagaaaactggttgtcctggatgtttgaaaagttggtcgttgtcatggtgtgtt

SEQ ID NO: 2487 - DNA, 60 bp, Homo sapiens
cacgggatttttgttgatggctgaattcttgtggattcataagaggatcatgcccttagc

SEQ ID NO: 2488 - DNA, 60 bp, Homo sapiens
gtttgtttccttttaagtactgttgatcagttgtgacacttactggttaaacttacgttg

SEQ ID NO: 2489 - DNA, 60 bp, Homo sapiens; identical to SEQ ID NO: 584

SEQ ID NO: 2490 - DNA, 60 bp, Homo sapiens
ctgctgtgatatgatagatgtggttattgacatctcttgtatttatggtctcaaagaaga

SEQ ID NO: 2491 - DNA, 60 bp, Homo sapiens; identical to SEQ ID NO: 990

SEQ ID NO: 2492 - DNA, 60 bp, Homo sapiens
ggaggtcaattgcacagcagaatgttccagaattttcctactgagttgttgctgtcatta

SEQ ID NO: 2493 - DNA, 60 bp, Homo sapiens; identical to SEQ ID NO: 991

SEQ ID NO: 2494 - DNA, 60 bp, Homo sapiens; identical to SEQ ID NO: 992

SEQ ID NO: 2495 - DNA, 60 bp, Homo sapiens
gaccagaaccacatgagtcagaatcatcagaatatcccaccaacaaatacagagagaaga

SEQ ID NO: 2496 - DNA, 60 bp, Homo sapiens; identical to SEQ ID NO: 586

SEQ ID NO: 2497 - DNA, 60 bp, Homo sapiens; identical to SEQ ID NO: 587

SEQ ID NO: 2498 - DNA, 60 bp, Homo sapiens
aagaacattctgtcaaacaagacattgagagaacataattcatttgtggagagatgcatc

SEQ ID NO: 2499 - DNA, 60 bp, Homo sapiens; identical to SEQ ID NO: 588

SEQ ID NO: 2500 - DNA, 60 bp, Homo sapiens; identical to SEQ ID NO: 995

SEQ ID NO: 2501 - DNA, 60 bp, Homo sapiens
tgactttcatgtcactcactataaaataggtctcttaacctggcaccagtataactataa

SEQ ID NO: 2502 - DNA, 60 bp, Homo sapiens; identical to SEQ ID NO: 998

SEQ ID NO: 2503 - DNA, 60 bp, Homo sapiens; identical to SEQ ID NO: 593

SEQ ID NO: 2504 - DNA, 60 bp, Homo sapiens
tactgtaggctgctttggaaataattcccatatccttgctttgtaagttggtaatatcac

SEQ ID NO: 2505 - DNA, 60 bp, Homo sapiens; identical to SEQ ID NO: 1001

SEQ ID NO: 2506 - DNA, 60 bp, Homo sapiens; identical to SEQ ID NO: 595

SEQ ID NO: 2507 - DNA, 60 bp, Homo sapiens; identical to SEQ ID NO: 1006

SEQ ID NO: 2508 - DNA, 60 bp, Homo sapiens; identical to SEQ ID NO: 597

SEQ ID NO: 2509 - DNA, 60 bp, Homo sapiens
ttgcaccactgtgtttggtttgtacttttttaggtaaatctatatgctgaaaagtagagc

SEQ ID NO: 2510 - DNA, 60 bp, Homo sapiens; identical to SEQ ID NO: 1009

SEQ ID NO: 2511 - DNA, 60 bp, Homo sapiens; identical to SEQ ID NO: 601

SEQ ID NO: 2512 - DNA, 60 bp, Homo sapiens; identical to SEQ ID NO: 1011

SEQ ID NO: 2513 - DNA, 60 bp, Homo sapiens; identical to SEQ ID NO: 1012

SEQ ID NO: 2514 - DNA, 60 bp, Homo sapiens; identical to SEQ ID NO: 1772

SEQ ID NO: 2515 - DNA, 60 bp, Homo sapiens; identical to SEQ ID NO: 602

SEQ ID NO: 2516 - DNA, 60 bp, Homo sapiens; identical to SEQ ID NO: 603

SEQ ID NO: 2517 - DNA, 60 bp, Homo sapiens; identical to SEQ ID NO: 1014

SEQ ID NO: 2518 - DNA, 60 bp, Homo sapiens; identical to SEQ ID NO: 1015

SEQ ID NO: 2519 - DNA, 60 bp, Homo sapiens; identical to SEQ ID NO: 607

SEQ ID NO: 2520 - DNA, 60 bp, Homo sapiens; identical to SEQ ID NO: 608

SEQ ID NO: 2521 - DNA, 60 bp, Homo sapiens
ttcacgtgtttagtagctccggttttcaagttaaatggtcttattacgccttggcttcat

SEQ ID NO: 2522 - DNA, 60 bp, Homo sapiens; identical to SEQ ID NO: 1019

SEQ ID NO: 2523 - DNA, 60 bp, Homo sapiens; identical to SEQ ID NO: 1020

SEQ ID NO: 2524 - DNA, 60 bp, Homo sapiens; identical to SEQ ID NO: 609

SEQ ID NO: 2525 - DNA, 60 bp, Homo sapiens; identical to SEQ ID NO: 1022

SEQ ID NO: 2526 - DNA, 60 bp, Homo sapiens; identical to SEQ ID NO: 610

SEQ ID NO: 2527 - DNA, 60 bp, Homo sapiens; identical to SEQ ID NO: 1784

SEQ ID NO: 2528 - DNA, 60 bp, Homo sapiens; identical to SEQ ID NO: 1024

SEQ ID NO: 2529 - DNA, 60 bp, Homo sapiens
ttgtctcatgaccaaatccacgctcaattagagccattcaaaattccttaagatcatggg

SEQ ID NO: 2530 - DNA, 60 bp, Homo sapiens; identical to SEQ ID NO: 1027

SEQ ID NO: 2531 - DNA, 60 bp, Homo sapiens; identical to SEQ ID NO: 611

SEQ ID NO: 2532 - DNA, 60 bp, Homo sapiens
aaatgagtacgaagataaccaaatctgctactggcacattagactcaagtatggtcagcg

SEQ ID NO: 2533 - DNA, 60 bp, Homo sapiens
aggcacagaatgcttattctcgtcactgtcctttctatgtcagcattcagagttactggc

SEQ ID NO: 2534 - DNA, 60 bp, Homo sapiens
gcattatgcaaatgcattatattttatgtaacctgtccactgttggtaggcacttgagtt

SEQ ID NO: 2535 - DNA, 60 bp, Homo sapiens; identical to SEQ ID NO: 1032

SEQ ID NO: 2536 - DNA, 60 bp, Homo sapiens; identical to SEQ ID NO: 1033

SEQ ID NO: 2537 - DNA, 60 bp, Homo sapiens
gggaggttagatgtgtgtttcaggcttggagtgtatgagtggttttgcttgtattttcct

SEQ ID NO: 2538 - DNA, 60 bp, Homo sapiens; identical to SEQ ID NO: 1034

SEQ ID NO: 2539 - DNA, 60 bp, Homo sapiens
catattccatttttaagaagaggtgttccagttctgcatctgataccgtctcctttccct

SEQ ID NO: 2540 - DNA, 60 bp, Homo sapiens
aaacctgagtatcattgcatgaatttttatctccctatggttatatcctgcatcaagtgg

SEQ ID NO: 2541 - DNA, 60 bp, Homo sapiens; identical to SEQ ID NO: 615

SEQ ID NO: 2542 - DNA, 60 bp, Homo sapiens; identical to SEQ ID NO: 1037

SEQ ID NO: 2543 - DNA, 60 bp, Homo sapiens; identical to SEQ ID NO: 616

SEQ ID NO: 2544 - DNA, 60 bp, Homo sapiens; identical to SEQ ID NO: 618

SEQ ID NO: 2545 - DNA, 60 bp, Homo sapiens
aaatgtcaacaaagggaaaataaactatcagcttggatggtcacttgaatagaagatggt

SEQ ID NO: 2546 - DNA, 60 bp, Homo sapiens
ctgtcaaattgccacgatctcactaaaggatttctatttgctgtcagttaaaaataaagc

SEQ ID NO: 2547 - DNA, 60 bp, Homo sapiens; identical to SEQ ID NO: 1042

SEQ ID NO: 2548 - DNA, 60 bp, Homo sapiens; identical to SEQ ID NO: 1044

SEQ ID NO: 2549 - DNA, 60 bp, Homo sapiens; identical to SEQ ID NO: 619

SEQ ID NO: 2550 - DNA, 60 bp, Homo sapiens; identical to SEQ ID NO: 1047

SEQ ID NO: 2551 - DNA, 60 bp, Homo sapiens; identical to SEQ ID NO: 620

SEQ ID NO: 2552 - DNA, 60 bp, Homo sapiens; identical to SEQ ID NO: 1049

SEQ ID NO: 2553 - DNA, 60 bp, Homo sapiens; identical to SEQ ID NO: 1050

SEQ ID NO: 2554 - DNA, 60 bp, Homo sapiens; identical to SEQ ID NO: 1052

SEQ ID NO: 2555 - DNA, 60 bp, Homo sapiens; identical to SEQ ID NO: 623

SEQ ID NO: 2556 - DNA, 60 bp, Homo sapiens; identical to SEQ ID NO: 1806

SEQ ID NO: 2557 - DNA, 60 bp, Homo sapiens; identical to SEQ ID NO: 1053

SEQ ID NO: 2558 - DNA, 60 bp, Homo sapiens; identical to SEQ ID NO: 1056

SEQ ID NO: 2559 - DNA, 60 bp, Homo sapiens; identical to SEQ ID NO: 1057

SEQ ID NO: 2560 - DNA, 60 bp, Homo sapiens; identical to SEQ ID NO: 1058

SEQ ID NO: 2561 - DNA, 60 bp, Homo sapiens; identical to SEQ ID NO: 1059

SEQ ID NO: 2562 - DNA, 60 bp, Homo sapiens; identical to SEQ ID NO: 1061

SEQ ID NO: 2563 - DNA, 60 bp, Homo sapiens; identical to SEQ ID NO: 628

SEQ ID NO: 2564 - DNA, 60 bp, Homo sapiens; identical to SEQ ID NO: 1062

SEQ ID NO: 2565 - DNA, 60 bp, Homo sapiens
tccattaccctttcttcctcataggtagtaattaccaatgtaactaagcatttgtgttct

SEQ ID NO: 2566 - DNA, 60 bp, Homo sapiens; identical to SEQ ID NO: 1063

SEQ ID NO: 2567 - DNA, 60 bp, Homo sapiens
aattaggttttcaacatgggaagcatgaaatccacttctggatttggagcatccacttga

SEQ ID NO: 2568 - DNA, 60 bp, Homo sapiens
gttgaaatttgggtggataaatttctggattttctatctattccatgttggaccaatacc

SEQ ID NO: 2569 - DNA, 60 bp, Homo sapiens; identical to SEQ ID NO: 1819

SEQ ID NO: 2570 - DNA, 60 bp, Homo sapiens; identical to SEQ ID NO: 632

SEQ ID NO: 2571 - DNA, 60 bp, Homo sapiens
atgttagatgcagtagacgatacaggttgcatgtggacactcagtcacattaacaacttg

SEQ ID NO: 2572 - DNA, 60 bp, Homo sapiens; identical to SEQ ID NO: 633

SEQ ID NO: 2573 - DNA, 60 bp, Homo sapiens
aaacaaagcatttccttaaaatgtttgctaggttaagctgtgctgttctactgatggttg

SEQ ID NO: 2574 - DNA, 60 bp, Homo sapiens
tttattactcccagaacaacaactatcctgacttctaatatcattcactagctttgcctg

SEQ ID NO: 2575 - DNA, 60 bp, Homo sapiens; identical to SEQ ID NO: 1070

SEQ ID NO: 2576 - DNA, 60 bp, Homo sapiens; identical to SEQ ID NO: 635

SEQ ID NO: 2577 - DNA, 60 bp, Homo sapiens; identical to SEQ ID NO: 1072

SEQ ID NO: 2578 - DNA, 60 bp, Homo sapiens; identical to SEQ ID NO: 1073

SEQ ID NO: 2579 - DNA, 60 bp, Homo sapiens
atgaactcgatgctaagcagggtagatggtatgtggtacaaacaaattatgaccgttgga

SEQ ID NO: 2580 - DNA, 60 bp, Homo sapiens; identical to SEQ ID NO: 1075

SEQ ID NO: 2581 - DNA, 60 bp, Homo sapiens; identical to SEQ ID NO: 1076

SEQ ID NO: 2582 - DNA, 60 bp, Homo sapiens
cacaagcatgagttcttgttcttcagttaaaagagcttctttcacagtgttgataacaaa

SEQ ID NO: 2583 - DNA, 60 bp, Homo sapiens; identical to SEQ ID NO: 1077

SEQ ID NO: 2584 - DNA, 60 bp, Homo sapiens; identical to SEQ ID NO: 1078

SEQ ID NO: 2585 - DNA, 60 bp, Homo sapiens; identical to SEQ ID NO: 1840

SEQ ID NO: 2586 - DNA, 60 bp, Homo sapiens
gagctggtgcgaaaagatctgcaaaattttctcaagaaggagaataagaatgaaaaggtc

SEQ ID NO: 2587 - DNA, 60 bp, Homo sapiens
catctttgctaagtgtctgattatcttctatcccctaggaggaaagagtggtccatgttg

SEQ ID NO: 2588 - DNA, 60 bp, Homo sapiens; identical to SEQ ID NO: 1081

SEQ ID NO: 2589 - DNA, 60 bp, Homo sapiens
agctgacccagcatcagccacactctgggttggaaaatgtttgcctgttggaattaattt

SEQ ID NO: 2590 - DNA, 60 bp, Homo sapiens
aagccacatcttatttttccaaggtttaatttagtgagagggcagcattagtgtggagtg

SEQ ID NO: 2591 - DNA, 60 bp, Homo sapiens; identical to SEQ ID NO: 1082

SEQ ID NO: 2592 - DNA, 60 bp, Homo sapiens; identical to SEQ ID NO: 1083

SEQ ID NO: 2593 - DNA, 60 bp, Homo sapiens; identical to SEQ ID NO: 1084

SEQ ID NO: 2594 - DNA, 60 bp, Homo sapiens
cctgatggatctgagaagatggacgtggaggatgaaaatctgtctgattagttttgactg

SEQ ID NO: 2595 - DNA, 60 bp, Homo sapiens
ttgggaagaaacgtgaactcaaggaagactcactatggtcagctaaagaaatatctaaca

SEQ ID NO: 2596 - DNA, 60 bp, Homo sapiens
ctatgacacctttaaggaggttcttggatcagggatgcagtacccacttgcagtcaaaat

SEQ ID NO: 2597 - DNA, 60 bp, Homo sapiens; identical to SEQ ID NO: 1088

SEQ ID NO: 2598 - DNA, 60 bp, Homo sapiens; identical to SEQ ID NO: 644

SEQ ID NO: 2599 - DNA, 60 bp, Homo sapiens; identical to SEQ ID NO: 1090

SEQ ID NO: 2600 - DNA, 60 bp, Homo sapiens; identical to SEQ ID NO: 1854

SEQ ID NO: 2601 - DNA, 60 bp, Homo sapiens; identical to SEQ ID NO: 645

SEQ ID NO: 2602 - DNA, 60 bp, Homo sapiens
gaattccaacgaagcatacctaggggtaacagtgaacctacctgggtttgttttgttttg

SEQ ID NO: 2603 - DNA, 60 bp, Homo sapiens
ttatgctgctcctgatataacactttccagcctatagcagaagcacattttcagactgca

SEQ ID NO: 2604 - DNA, 60 bp, Homo sapiens; identical to SEQ ID NO: 1093

SEQ ID NO: 2605 - DNA, 60 bp, Homo sapiens; identical to SEQ ID NO: 1094

SEQ ID NO: 2606 - DNA, 60 bp, Homo sapiens; identical to SEQ ID NO: 1097

SEQ ID NO: 2607 - DNA, 60 bp, Homo sapiens
agaagaatgagatactgatgtccacagttcattggcagaatctaaccccttctgttatct

SEQ ID NO: 2608 - DNA, 60 bp, Homo sapiens; identical to SEQ ID NO: 648

SEQ ID NO: 2609 - DNA, 60 bp, Homo sapiens; identical to SEQ ID NO: 1100

SEQ ID NO: 2610 - DNA, 60 bp, Homo sapiens
ttggtcaagtatttctcacatcttttgttatcagagtaccattccaatctcttaacttgc

SEQ ID NO: 2611 - DNA, 60 bp, Homo sapiens; identical to SEQ ID NO: 650

SEQ ID NO: 2612 - DNA, 60 bp, Homo sapiens; identical to SEQ ID NO: 1105

SEQ ID NO: 2613 - DNA, 60 bp, Homo sapiens; identical to SEQ ID NO: 1107

SEQ ID NO: 2614 - DNA, 60 bp, Homo sapiens; identical to SEQ ID NO: 654

SEQ ID NO: 2615 - DNA, 60 bp, Homo sapiens; identical to SEQ ID NO: 1109

SEQ ID NO: 2616 - DNA, 60 bp, Homo sapiens
tggtggtgtttgagggttggctagaaatgaaagcctggattttgtgccatgtttgtaata

SEQ ID NO: 2617 - DNA, 60 bp, Homo sapiens; identical to SEQ ID NO: 656

SEQ ID NO: 2618 - DNA, 60 bp, Homo sapiens; identical to SEQ ID NO: 657

SEQ ID NO: 2619 - DNA, 60 bp, Homo sapiens
tagttgaggctagtctggaacctttcattagagcaatatttggttattgcacttcatttt

SEQ ID NO: 2620 - DNA, 60 bp, Homo sapiens
tgtctaagtcacaaatctgaagaaataagagattgtctgtagttgattgaaacgagggca

SEQ ID NO: 2621 - DNA, 60 bp, Homo sapiens; identical to SEQ ID NO: 1111

SEQ ID NO: 2622 - DNA, 60 bp, Homo sapiens; identical to SEQ ID NO: 1112

SEQ ID NO: 2623 - DNA, 60 bp, Homo sapiens
tttaggttccaactgtgttagacatgagtttgctagatccatggtctctagatggtttac

SEQ ID NO: 2624 - DNA, 60 bp, Homo sapiens; identical to SEQ ID NO: 1113

SEQ ID NO: 2625 - DNA, 60 bp, Homo sapiens; identical to SEQ ID NO: 1114

SEQ ID NO: 2626 - DNA, 60 bp, Homo sapiens; identical to SEQ ID NO: 1115

SEQ ID NO: 2627 - DNA, 60 bp, Homo sapiens; identical to SEQ ID NO: 660

SEQ ID NO: 2628 - DNA, 60 bp, Homo sapiens; identical to SEQ ID NO: 661

SEQ ID NO: 2629 - DNA, 60 bp, Homo sapiens; identical to SEQ ID NO: 1118

SEQ ID NO: 2630 - DNA, 60 bp, Homo sapiens
tgcatttgtggaccagtgccatttacagaacaaggagtaaggttgctgcatgatctcaac

SEQ ID NO: 2631 - DNA, 60 bp, Homo sapiens; identical to SEQ ID NO: 662

SEQ ID NO: 2632 - DNA, 60 bp, Homo sapiens; identical to SEQ ID NO: 1121

SEQ ID NO: 2633 - DNA, 60 bp, Homo sapiens
ggctatggcttcggctatggctacaacggctgtggggctttcggctacaggagatactcg

SEQ ID NO: 2634 - DNA, 60 bp, Homo sapiens; identical to SEQ ID NO: 1122

SEQ ID NO: 2635 - DNA, 60 bp, Homo sapiens; identical to SEQ ID NO: 1123

SEQ ID NO: 2636 - DNA, 60 bp, Homo sapiens
ttgaacccggtagtttgtttgacctagttagattgtggtgtttattcaagtttgaaatca

SEQ ID NO: 2637 - DNA, 60 bp, Homo sapiens; identical to SEQ ID NO: 1126

SEQ ID NO: 2638 - DNA, 60 bp, Homo sapiens
ccttgatatagagggacctagacggacaggatatgctaaaataatttcaaattctagcac

SEQ ID NO: 2639 - DNA, 60 bp, Homo sapiens
aaccacgttctaaaccaagtttttaatcttcttggggctcgtaattacctttcactttaa

SEQ ID NO: 2640 - DNA, 60 bp, Homo sapiens; identical to SEQ ID NO: 667

SEQ ID NO: 2641 - DNA, 60 bp, Homo sapiens; identical to SEQ ID NO: 1129

SEQ ID NO: 2642 - DNA, 60 bp, Homo sapiens; identical to SEQ ID NO: 671

SEQ ID NO: 2643 - DNA, 60 bp, Homo sapiens
ctgtctccctgtttgtgtaaacatactagagtatactgcggcgtgttttctgtctaccca

SEQ ID NO: 2644 - DNA, 60 bp, Homo sapiens; identical to SEQ ID NO: 1133

SEQ ID NO: 2645 - DNA, 60 bp, Homo sapiens; identical to SEQ ID NO: 672

SEQ ID NO: 2646 - DNA, 60 bp, Homo sapiens
caataactcgtcttcacaaagctatggtgtttcttgaatatttcacaagtaattcttggg

SEQ ID NO: 2647 - DNA, 60 bp, Homo sapiens; identical to SEQ ID NO: 1135

SEQ ID NO: 2648 - DNA, 60 bp, Homo sapiens; identical to SEQ ID NO: 676

SEQ ID NO: 2649 - DNA, 60 bp, Homo sapiens; identical to SEQ ID NO: 1136

SEQ ID NO: 2650 - DNA, 60 bp, Homo sapiens
tgattgtcaaaatgtacagccacagccttttaatttgggagcccctgttgtcattcaaat

SEQ ID NO: 2651 - DNA, 60 bp, Homo sapiens; identical to SEQ ID NO: 1137

SEQ ID NO: 2652 - DNA, 60 bp, Homo sapiens; identical to SEQ ID NO: 1138

SEQ ID NO: 2653 - DNA, 60 bp, Homo sapiens
ttgctaatataggaatatcaggttgactatatagccatacttgaaaatgcttctgagtgg

SEQ ID NO: 2654 - DNA, 60 bp, Homo sapiens; identical to SEQ ID NO: 1140

SEQ ID NO: 2655 - DNA, 60 bp, Homo sapiens
gtgcatgttgtagcaaacatttctgtaaattatcacaagctctgttacctttatatacgc

SEQ ID NO: 2656 - DNA, 60 bp, Homo sapiens; identical to SEQ ID NO: 679

SEQ ID NO: 2657 - DNA, 60 bp, Homo sapiens; identical to SEQ ID NO: 680

SEQ ID NO: 2658 - DNA, 60 bp, Homo sapiens; identical to SEQ ID NO: 1145

SEQ ID NO: 2659 - DNA, 60 bp, Homo sapiens; identical to SEQ ID NO: 1148

SEQ ID NO: 2660 - DNA, 60 bp, Homo sapiens; identical to SEQ ID NO: 682

SEQ ID NO: 2661 - DNA, 60 bp, Homo sapiens; identical to SEQ ID NO: 1151

SEQ ID NO: 2662 - DNA, 60 bp, Homo sapiens; identical to SEQ ID NO: 683

SEQ ID NO: 2663 - DNA, 60 bp, Homo sapiens; identical to SEQ ID NO: 685

SEQ ID NO: 2664 - DNA, 60 bp, Homo sapiens
tccatctctgacttgttggaaatttggtgaattatccactcagattcccgagttaggacc

SEQ ID NO: 2665 - DNA, 60 bp, Homo sapiens
acaagtacctgggcatgaatttccatttcgattcagatgggactggaaacaaccattcaa

SEQ ID NO: 2666 - DNA, 60 bp, Homo sapiens
aggctaggctggccatcagttgcttatttcagatgtgtcactaaattttccttctagatg

SEQ ID NO: 2667 - DNA, 60 bp, Homo sapiens; identical to SEQ ID NO: 1156

SEQ ID NO: 2668 - DNA, 60 bp, Homo sapiens
agcatttgaatactattaatattcggcatattgctaattcaattcgaacacatggcacgg

SEQ ID NO: 2669 - DNA, 60 bp, Homo sapiens; identical to SEQ ID NO: 1158

SEQ ID NO: 2670 - DNA, 60 bp, Homo sapiens; identical to SEQ ID NO: 1159

SEQ ID NO: 2671 - DNA, 60 bp, Homo sapiens; identical to SEQ ID NO: 1160

SEQ ID NO: 2672 - DNA, 60 bp, Homo sapiens
acatatcattgtgaccccagaagatggaatctatggttggatcttcaccagggagagcat

SEQ ID NO: 2673 - DNA, 60 bp, Homo sapiens
tcaaaaggccctagctaataaacctgtaagcccagcatttgagagaaggtagggtgtgta

SEQ ID NO: 2674 - DNA, 60 bp, Homo sapiens; identical to SEQ ID NO: 1162

SEQ ID NO: 2675 - DNA, 60 bp, Homo sapiens
ttactattctgaagggtagtgttgttggttttcatcttcaagaagttgattccaaaactg

SEQ ID NO: 2676 - DNA, 60 bp, Homo sapiens
taatatccccaaacctgagatgagcactacgatggcagagagcagcctgttggacctgct

SEQ ID NO: 2677 - DNA, 60 bp, Homo sapiens; identical to SEQ ID NO: 689

SEQ ID NO: 2678 - DNA, 60 bp, Homo sapiens; identical to SEQ ID NO: 691

SEQ ID NO: 2679 - DNA, 60 bp, Homo sapiens; identical to SEQ ID NO: 692

SEQ ID NO: 2680 - DNA, 60 bp, Homo sapiens; identical to SEQ ID NO: 1169

SEQ ID NO: 2681 - DNA, 60 bp, Homo sapiens
cagaggtggggccatagaatcctacactacagctttcagttttttagaaaatgtgataat

SEQ ID NO: 2682 - DNA, 60 bp, Homo sapiens; identical to SEQ ID NO: 1171

SEQ ID NO: 2683 - DNA, 60 bp, Homo sapiens; identical to SEQ ID NO: 695

SEQ ID NO: 2684 - DNA, 60 bp, Homo sapiens
tccagaacatcttgtagagtcatttcatttaacacaggaactgagacttttgaaggaaga

SEQ ID NO: 2685 - DNA, 60 bp, Homo sapiens; identical to SEQ ID NO: 697

SEQ ID NO: 2686 - DNA, 60 bp, Homo sapiens
accaatactctttccatattgtctttttcagtgaagagaaatgcattcaagattaggtcc

SEQ ID NO: 2687 - DNA, 60 bp, Homo sapiens
ttcaggctggtggtttgatgcatgtctttctgcaaacttaaatggcaaatattatcacca

SEQ ID NO: 2688 - DNA, 60 bp, Homo sapiens; identical to SEQ ID NO: 698

SEQ ID NO: 2689 - DNA, 60 bp, Homo sapiens; identical to SEQ ID NO: 1176

SEQ ID NO: 2690 - DNA, 60 bp, Homo sapiens
ccactaccctttcttcctcatagatagtaattaccaatgtaactaagtatttgtgttctg

SEQ ID NO: 2691 - DNA, 60 bp, Homo sapiens; identical to SEQ ID NO: 701

SEQ ID NO: 2692 - DNA, 60 bp, Homo sapiens; identical to SEQ ID NO: 1179

SEQ ID NO: 2693 - DNA, 60 bp, Homo sapiens; identical to SEQ ID NO: 703

SEQ ID NO: 2694 - DNA, 60 bp, Homo sapiens
tctgttggtgtagatgcgcgtcatccttctttcttcctctacagaagtggtgtctactat

SEQ ID NO: 2695 - DNA, 60 bp, Homo sapiens; identical to SEQ ID NO: 1183

SEQ ID NO: 2696 - DNA, 60 bp, Homo sapiens; identical to SEQ ID NO: 1184

SEQ ID NO: 2697 - DNA, 60 bp, Homo sapiens; identical to SEQ ID NO: 704

SEQ ID NO: 2698 - DNA, 60 bp, Homo sapiens; identical to SEQ ID NO: 706

SEQ ID NO: 2699 - DNA, 60 bp, Homo sapiens; identical to SEQ ID NO: 1189

SEQ ID NO: 2700 - DNA, 60 bp, Homo sapiens; identical to SEQ ID NO: 1191

SEQ ID NO: 2701 - DNA, 60 bp, Homo sapiens
gacaaagatgaacccatacatgatcagctccacggtaatttttagggactcaggagaatc

SEQ ID NO: 2702 - DNA, 60 bp, Homo sapiens; identical to SEQ ID NO: 707

SEQ ID NO: 2703 - DNA, 60 bp, Homo sapiens
attcagtcattaatagaaatggagtgatttcacagtgtgtactgttttgccacatacttc

SEQ ID NO: 2704 - DNA, 60 bp, Homo sapiens
gtttagaaccattagtaaatgatttaacactacgcattgggagattggttaccgacttac

SEQ ID NO: 2705 - DNA, 60 bp, Homo sapiens; identical to SEQ ID NO: 1195

SEQ ID NO: 2706 - DNA, 60 bp, Homo sapiens
cgttgaattgatgatgcagttttcatatatcgagatgttcgctcgtgcagtactgttggt

SEQ ID NO: 2707 - DNA, 60 bp, Homo sapiens; identical to SEQ ID NO: 1197

SEQ ID NO: 2708 - DNA, 60 bp, Homo sapiens; identical to SEQ ID NO: 1199

SEQ ID NO: 2709 - DNA, 60 bp, Homo sapiens; identical to SEQ ID NO: 1200

SEQ ID NO: 2710 - DNA, 60 bp, Homo sapiens
ttgggaggaggaaaagaaacctggggtgaatacttattttcagtgcatcattactgttcc

SEQ ID NO: 2711 - DNA, 60 bp, Homo sapiens
ctgcgttaaaggctcgattttgtatctgcaggcagacacggatctgagaatctttattga

SEQ ID NO: 2712 - DNA, 60 bp, Homo sapiens; identical to SEQ ID NO: 711

SEQ ID NO: 2713 - DNA, 60 bp, Homo sapiens; identical to SEQ ID NO: 1203

SEQ ID NO: 2714 - DNA, 60 bp, Homo sapiens; identical to SEQ ID NO: 1204

SEQ ID NO: 2715 - DNA, 60 bp, Homo sapiens; identical to SEQ ID NO: 713

SEQ ID NO: 2716 - DNA, 60 bp, Homo sapiens; identical to SEQ ID NO: 1206

SEQ ID NO: 2717 - DNA, 60 bp, Homo sapiens; identical to SEQ ID NO: 1207

SEQ ID NO: 2718 - DNA, 60 bp, Homo sapiens
agcaacactttatccatttattctgagaatgtgcaggaggggttagtgaaggggaattaa

SEQ ID NO: 2719 - DNA, 60 bp, Homo sapiens; identical to SEQ ID NO: 1211

SEQ ID NO: 2720 - DNA, 60 bp, Homo sapiens; identical to SEQ ID NO: 715

SEQ ID NO: 2721 - DNA, 60 bp, Homo sapiens; identical to SEQ ID NO: 716

SEQ ID NO: 2722 - DNA, 60 bp, Homo sapiens; identical to SEQ ID NO: 718

SEQ ID NO: 2723 - DNA, 60 bp, Homo sapiens; identical to SEQ ID NO: 1216

SEQ ID NO: 2724 - DNA, 60 bp, Homo sapiens; identical to SEQ ID NO: 1217

SEQ ID NO: 2725 - DNA, 60 bp, Homo sapiens; identical to SEQ ID NO: 1219

SEQ ID NO: 2726 - DNA, 60 bp, Homo sapiens; identical to SEQ ID NO: 1980

SEQ ID NO: 2727 - DNA, 60 bp, Homo sapiens
ggtcttccaatcagtgtgtgtaacatacctgttgtttatcagccattgtaggtggctgtg

SEQ ID NO: 2728 - DNA, 60 bp, Homo sapiens; identical to SEQ ID NO: 720

SEQ ID NO: 2729 - DNA, 60 bp, Homo sapiens; identical to SEQ ID NO: 722

SEQ ID NO: 2730 - DNA, 60 bp, Homo sapiens
ccttgtttgtggagtcaagtgttgatatacttgaggcatgttatgtgtcttctaattaat

SEQ ID NO: 2731 - DNA, 60 bp, Homo sapiens; identical to SEQ ID NO: 1224

SEQ ID NO: 2732 - DNA, 60 bp, Homo sapiens; identical to SEQ ID NO: 1226

SEQ ID NO: 2733 - DNA, 60 bp, Homo sapiens
aaattgttgaaaggtccagttctcagtaccatgtgagttaatgatactacaactaagttc

SEQ ID NO: 2734 - DNA, 60 bp, Homo sapiens; identical to SEQ ID NO: 1227

SEQ ID NO: 2735 - DNA, 60 bp, Homo sapiens; identical to SEQ ID NO: 1229

SEQ ID NO: 2736 - DNA, 60 bp, Homo sapiens; identical to SEQ ID NO: 1993

SEQ ID NO: 2737 - DNA, 60 bp, Homo sapiens; identical to SEQ ID NO: 1231

SEQ ID NO: 2738 - DNA, 60 bp, Homo sapiens; identical to SEQ ID NO: 1235

SEQ ID NO: 2739 - DNA, 60 bp, Homo sapiens; identical to SEQ ID NO: 725

SEQ ID NO: 2740 - DNA, 60 bp, Homo sapiens; identical to SEQ ID NO: 1237

SEQ ID NO: 2741 - DNA, 60 bp, Homo sapiens; identical to SEQ ID NO: 2000

SEQ ID NO: 2742 - DNA, 60 bp, Homo sapiens; identical to SEQ ID NO: 726

SEQ ID NO: 2743 - DNA, 60 bp, Homo sapiens; identical to SEQ ID NO: 727

SEQ ID NO: 2744 - DNA, 60 bp, Homo sapiens; identical to SEQ ID NO: 1242

SEQ ID NO: 2745 - DNA, 60 bp, Homo sapiens
tggtttacagttaatgctgatcttgtattttaaattccaacactttgtgtcactacctcc

SEQ ID NO: 2746 - DNA, 60 bp, Homo sapiens; identical to SEQ ID NO: 730

SEQ ID NO: 2747 - DNA, 60 bp, Homo sapiens; identical to SEQ ID NO: 1247

SEQ ID NO: 2748 - DNA, 60 bp, Homo sapiens; identical to SEQ ID NO: 1248

SEQ ID NO: 2749 - DNA, 60 bp, Homo sapiens
ctttacatccagataggttaccagtaacggaacagtatccagtactcctggttcctaggt

SEQ ID NO: 2750 - DNA, 60 bp, Homo sapiens; identical to SEQ ID NO: 737

SEQ ID NO: 2751 - DNA, 60 bp, Homo sapiens
acctccctctgaaaaacacaaagaatggactctctcctgggatgaggacttgctttcttt

SEQ ID NO: 2752 - DNA, 60 bp, Homo sapiens; identical to SEQ ID NO: 738

SEQ ID NO: 2753 - DNA, 60 bp, Homo sapiens; identical to SEQ ID NO: 739

SEQ ID NO: 2754 - DNA, 60 bp, Homo sapiens; identical to SEQ ID NO: 1252

SEQ ID NO: 2755 - DNA, 60 bp, Homo sapiens
tttaagagcgatcctcatcccttcagcaatatgtatttgagttcacactatttctgtttt

SEQ ID NO: 2756 - DNA, 60 bp, Homo sapiens; identical to SEQ ID NO: 742

SEQ ID NO: 2757 - DNA, 60 bp, Homo sapiens; identical to SEQ ID NO: 1255

SEQ ID NO: 2758 - DNA, 60 bp, Homo sapiens; identical to SEQ ID NO: 1257

SEQ ID NO: 2759 - DNA, 60 bp, Homo sapiens; identical to SEQ ID NO: 1259

SEQ ID NO: 2760 - DNA, 60 bp, Homo sapiens; identical to SEQ ID NO: 1260

SEQ ID NO: 2761 - DNA, 60 bp, Homo sapiens; identical to SEQ ID NO: 1261

SEQ ID NO: 2762 - DNA, 60 bp, Homo sapiens
gggtcatttattgcccaagtttacaagagtagcgatacaagtttttgcaaattgaatttg

SEQ ID NO: 2763 - DNA, 60 bp, Homo sapiens; identical to SEQ ID NO: 744

SEQ ID NO: 2764 - DNA, 60 bp, Homo sapiens; identical to SEQ ID NO: 1266

SEQ ID NO: 2765 - DNA, 60 bp, Homo sapiens; identical to SEQ ID NO: 747

SEQ ID NO: 2766 - DNA, 60 bp, Homo sapiens; identical to SEQ ID NO: 1269

SEQ ID NO: 2767 - DNA, 60 bp, Homo sapiens; identical to SEQ ID NO: 1270

SEQ ID NO: 2768 - DNA, 60 bp, Homo sapiens
acagcaacaatgacttaaccatataaatgtggaggctatcaacaaagaatgggcttgaaa

SEQ ID NO: 2769 - DNA, 60 bp, Homo sapiens; identical to SEQ ID NO: 748

SEQ ID NO: 2770 - DNA, 60 bp, Homo sapiens
cccatcttgagggaggaccgttcctcagttaaggacttgtttatttaaatgggactgtaa

SEQ ID NO: 2771 - DNA, 60 bp, Homo sapiens
cctcacgatggagtttcatgcttcattttcacatctctctgcacaattagattgggagct

SEQ ID NO: 2772 - DNA, 60 bp, Homo sapiens; identical to SEQ ID NO: 1273

SEQ ID NO: 2773 - DNA, 60 bp, Homo sapiens
cgtctgcgtttactcttgttttcaaagggacttttgtaaaatcaaatcatcctgtcacaa

SEQ ID NO: 2774 - DNA, 60 bp, Homo sapiens; identical to SEQ ID NO: 1275

SEQ ID NO: 2775 - DNA, 60 bp, Homo sapiens; identical to SEQ ID NO: 1276

SEQ ID NO: 2776 - DNA, 60 bp, Homo sapiens; identical to SEQ ID NO: 1277

SEQ ID NO: 2777 - DNA, 60 bp, Homo sapiens; identical to SEQ ID NO: 1278

SEQ ID NO: 2778 - DNA, 60 bp, Homo sapiens; identical to SEQ ID NO: 752

SEQ ID NO: 2779 - DNA, 60 bp, Homo sapiens; identical to SEQ ID NO: 1280

SEQ ID NO: 2780 - DNA, 60 bp, Homo sapiens; identical to SEQ ID NO: 1282

SEQ ID NO: 2781 - DNA, 60 bp, Homo sapiens; identical to SEQ ID NO: 753

SEQ ID NO: 2782 - DNA, 60 bp, Homo sapiens; identical to SEQ ID NO: 756

SEQ ID NO: 2783 - DNA, 60 bp, Homo sapiens; identical to SEQ ID NO: 758

SEQ ID NO: 2784 - DNA, 60 bp, Homo sapiens; identical to SEQ ID NO: 1286

SEQ ID NO: 2785 - DNA, 60 bp, Homo sapiens; identical to SEQ ID NO: 1287

SEQ ID NO: 2786 - DNA, 60 bp, Homo sapiens; identical to SEQ ID NO: 1288

SEQ ID NO: 2787 - DNA, 60 bp, Homo sapiens; identical to SEQ ID NO: 762

SEQ ID NO: 2788 - DNA, 60 bp, Homo sapiens
tgttgaacgcagcttgtctaggaaggggatgggactagattctaaaatttatttgggacc

SEQ ID NO: 2789 - DNA, 60 bp, Homo sapiens; identical to SEQ ID NO: 763

SEQ ID NO: 2790 - DNA, 60 bp, Homo sapiens; identical to SEQ ID NO: 1293

SEQ ID NO: 2791 - DNA, 60 bp, Homo sapiens; identical to SEQ ID NO: 1294

SEQ ID NO: 2792 - DNA, 60 bp, Homo sapiens; identical to SEQ ID NO: 1295

SEQ ID NO: 2793 - DNA, 60 bp, Homo sapiens
aaccaaagctagaagcaaatgtcgagataagagagcagatgttggagaattcttctagat

SEQ ID NO: 2794 - DNA, 60 bp, Homo sapiens; identical to SEQ ID NO: 1299

SEQ ID NO: 2795 - DNA, 60 bp, Homo sapiens; identical to SEQ ID NO: 1302

SEQ ID NO: 2796 - DNA, 60 bp, Homo sapiens
gtatattttgtaataaccccgtagatactgtacctaacaaaacatgactcgtattagctc

SEQ ID NO: 2797 - DNA, 60 bp, Homo sapiens; identical to SEQ ID NO: 1305

SEQ ID NO: 2798 - DNA, 60 bp, Homo sapiens; identical to SEQ ID NO: 769

SEQ ID NO: 2799 - DNA, 60 bp, Homo sapiens; identical to SEQ ID NO: 1308

SEQ ID NO: 2800 - DNA, 60 bp, Homo sapiens
tcattccttcctgtatatttgtactcagagagccttattttattcttccagcagaattac

SEQ ID NO: 2801 - DNA, 60 bp, Homo sapiens
agcttacagtgtttcaggttgtgatttattttcaaaatggagttgactctgaacatcact

SEQ ID NO: 2802 - DNA, 60 bp, Homo sapiens; identical to SEQ ID NO: 1309

SEQ ID NO: 2803 - DNA, 60 bp, Homo sapiens; identical to SEQ ID NO: 1313

SEQ ID NO: 2804 - DNA, 60 bp, Homo sapiens; identical to SEQ ID NO: 1314

SEQ ID NO: 2805 - DNA, 60 bp, Homo sapiens; identical to SEQ ID NO: 1315

SEQ ID NO: 2806 - DNA, 60 bp, Homo sapiens; identical to SEQ ID NO: 771

SEQ ID NO: 2807 - DNA, 60 bp, Homo sapiens; identical to SEQ ID NO: 772

SEQ ID NO: 2808 - DNA, 60 bp, Homo sapiens; identical to SEQ ID NO: 776

SEQ ID NO: 2809 - DNA, 60 bp, Homo sapiens
gctctgttgaaaataatcctttgtcagaaaagaaggtagctaccacatcattttgaaagg

SEQ ID NO: 2810 - DNA, 60 bp, Homo sapiens; identical to SEQ ID NO: 1320

SEQ ID NO: 2811 - DNA, 60 bp, Homo sapiens; identical to SEQ ID NO: 2078

SEQ ID NO: 2812 - DNA, 60 bp, Homo sapiens; identical to SEQ ID NO: 1322

SEQ ID NO: 2813 - DNA, 60 bp, Homo sapiens
acctcaaacaaacaaaactaccaaatagatgacagatcagaataaaggtgagaggtctgg

SEQ ID NO: 2814 - DNA, 60 bp, Homo sapiens; identical to SEQ ID NO: 780

SEQ ID NO: 2815 - DNA, 60 bp, Homo sapiens; identical to SEQ ID NO: 781

SEQ ID NO: 2816 - DNA, 60 bp, Homo sapiens; identical to SEQ ID NO: 1329

SEQ ID NO: 2817 - DNA, 60 bp, Homo sapiens
gggagccttcttgatgatctcaaaaataatagctattcaagaaaatcaccaagtgactgt

SEQ ID NO: 2818 - DNA, 60 bp, Homo sapiens; identical to SEQ ID NO: 1330

SEQ ID NO: 2819 - DNA, 60 bp, Homo sapiens; identical to SEQ ID NO: 784

SEQ ID NO: 2820 - DNA, 60 bp, Homo sapiens; identical to SEQ ID NO: 785

SEQ ID NO: 2821 - DNA, 60 bp, Homo sapiens; identical to SEQ ID NO: 1336

SEQ ID NO: 2822 - DNA, 60 bp, Homo sapiens; identical to SEQ ID NO: 1338

SEQ ID NO: 2823 - DNA, 60 bp, Homo sapiens; identical to SEQ ID NO: 1342

SEQ ID NO: 2824 - DNA, 60 bp, Homo sapiens
ttttttccagtaattacctgtaaaatggtattattggaatgaaactatatttcctcatgt

SEQ ID NO: 2825 - DNA, 60 bp, Homo sapiens; identical to SEQ ID NO: 1343

SEQ ID NO: 2826 - DNA, 60 bp, Homo sapiens
attaaagagctctgaactgtattcagaccgactgggtatctagcttactgttttaacatc

SEQ ID NO: 2827 - DNA, 60 bp, Homo sapiens; identical to SEQ ID NO: 1344

SEQ ID NO: 2828 - DNA, 60 bp, Homo sapiens
gtatttgatgatagcattctcactaagacacatgagaatttaactttataaccgcgtgag

SEQ ID NO: 2829 - DNA, 60 bp, Homo sapiens; identical to SEQ ID NO: 1346

SEQ ID NO: 2830 - DNA, 60 bp, Homo sapiens
tgaattcttctttgattgtgttgcacatagatatggtagtctgctctgtatatttttccc

SEQ ID NO: 2831 - DNA, 60 bp, Homo sapiens; identical to SEQ ID NO: 1347

SEQ ID NO: 2832 - DNA, 60 bp, Homo sapiens; identical to SEQ ID NO: 1349

SEQ ID NO: 2833 - DNA, 60 bp, Homo sapiens
cagctccagaggtgtttcattacttcaaatacagcagcaagtcagacgtatgggcatttg

SEQ ID NO: 2834 - DNA, 60 bp, Homo sapiens; identical to SEQ ID NO: 791

SEQ ID NO: 2835 - DNA, 60 bp, Homo sapiens; identical to SEQ ID NO: 1351

SEQ ID NO: 2836 - DNA, 60 bp, Homo sapiens; identical to SEQ ID NO: 1352

SEQ ID NO: 2837 - DNA, 60 bp, Homo sapiens; identical to SEQ ID NO: 1353

SEQ ID NO: 2838 - DNA, 60 bp, Homo sapiens
agcaaaacaaagtgcaatattaaatgtttgctttatagattatattctatggctgtttgt

SEQ ID NO: 2839 - DNA, 60 bp, Homo sapiens; identical to SEQ ID NO: 1354

SEQ ID NO: 2840 - DNA, 60 bp, Homo sapiens; identical to SEQ ID NO: 792

SEQ ID NO: 2841 - DNA, 60 bp, Homo sapiens
catggtataatgtattcagactttgattactacttatttaaaatggaatgttttatggtt

SEQ ID NO: 2842 - DNA, 60 bp, Homo sapiens; identical to SEQ ID NO: 1359

SEQ ID NO: 2843 - DNA, 60 bp, Homo sapiens
aacacacgccctgttctctacagtacaactgtgtgcaattaagcaatggtacttgatgta

SEQ ID NO: 2844 - DNA, 60 bp, Homo sapiens; identical to SEQ ID NO: 1360

SEQ ID NO: 2845 - DNA, 60 bp, Homo sapiens; identical to SEQ ID NO: 1362

SEQ ID NO: 2846 - DNA, 60 bp, Homo sapiens
ttaaagtaccttgggagtgtgtagagtaacttctataatagctttatgatcctgatgatg

SEQ ID NO: 2847 - DNA, 60 bp, Homo sapiens; identical to SEQ ID NO: 1363

SEQ ID NO: 2848 - DNA, 60 bp, Homo sapiens
tttttgaatagcctactcccaagtaagagcaaatctgtatgataacattttttcctctgg

SEQ ID NO: 2849 - DNA, 60 bp, Homo sapiens; identical to SEQ ID NO: 2127

SEQ ID NO: 2850 - DNA, 60 bp, Homo sapiens
gcgagaattcagtgtccagagtttaacatctgttgtcagtgaggagtgtttttatgaaac

SEQ ID NO: 2851 - DNA, 60 bp, Homo sapiens
actgtatgggtactcctaagaattatttcattttggatataaagaagttatgaggcctcc

SEQ ID NO: 2852 - DNA, 60 bp, Homo sapiens
gcttttggtagacagaaaaaacagaaaggtattcgttggtagaacatttttaagttcagg

SEQ ID NO: 2853 - DNA, 60 bp, Homo sapiens
ctcctctgtttatgtggacatgattcaactccaacttaaattgcagggctgtgtttccat

SEQ ID NO: 2854 - DNA, 60 bp, Homo sapiens; identical to SEQ ID NO: 1369

SEQ ID NO: 2855 - DNA, 60 bp, Homo sapiens; identical to SEQ ID NO: 1370

SEQ ID NO: 2856 - DNA, 60 bp, Homo sapiens
cccgcgtctttgtttggcctattgaggtttagcgttttaaccttaactgttgttttggac

SEQ ID NO: 2857 - DNA, 60 bp, Homo sapiens; identical to SEQ ID NO: 795

SEQ ID NO: 2858 - DNA, 60 bp, Homo sapiens; identical to SEQ ID NO: 796

SEQ ID NO: 2859 - DNA, 60 bp, Homo sapiens; identical to SEQ ID NO: 797

SEQ ID NO: 2860 - DNA, 60 bp, Homo sapiens
aagaatttaagtagcccccctgaagttagagttaaagaaggatattaactgccagtccca

SEQ ID NO: 2861 - DNA, 60 bp, Homo sapiens; identical to SEQ ID NO: 1377

SEQ ID NO: 2862 - DNA, 60 bp, Homo sapiens; identical to SEQ ID NO: 798

SEQ ID NO: 2863 - DNA, 60 bp, Homo sapiens; identical to SEQ ID NO: 799

SEQ ID NO: 2864 - DNA, 60 bp, Homo sapiens; identical to SEQ ID NO: 1378

SEQ ID NO: 2865 - DNA, 60 bp, Homo sapiens; identical to SEQ ID NO: 1379

SEQ ID NO: 2866 - DNA, 60 bp, Homo sapiens; identical to SEQ ID NO: 1380

SEQ ID NO: 2867 - DNA, 60 bp, Homo sapiens
agagcaaacgttttttaagtgtattctagttgcaaagtatgcacacatatcttgaatggc

SEQ ID NO: 2868 - DNA, 60 bp, Homo sapiens
atatccccttggatttcacttgcattgtgcaataagcaaagaagggttgataaaagttct

SEQ ID NO: 2869 - DNA, 60 bp, Homo sapiens; identical to SEQ ID NO: 1387

SEQ ID NO: 2870 - DNA, 60 bp, Homo sapiens; identical to SEQ ID NO: 1388

SEQ ID NO: 2871 - DNA, 60 bp, Homo sapiens
ataatatagaatgggatttactctgctttaccagttagtttcataataaacaaatagtct

SEQ ID NO: 2872 - DNA, 60 bp, Homo sapiens; identical to SEQ ID NO: 1389

SEQ ID NO: 2873 - DNA, 60 bp, Homo sapiens; identical to SEQ ID NO: 804

SEQ ID NO: 2874 - DNA, 60 bp, Homo sapiens; identical to SEQ ID NO: 2155

SEQ ID NO: 2875 - DNA, 60 bp, Homo sapiens
aatgtctattacggtttgcgatagtatttctctctagttctcagtgatttaaatgtgacc

SEQ ID NO: 2876 - DNA, 60 bp, Homo sapiens; identical to SEQ ID NO: 1391

SEQ ID NO: 2877 - DNA, 60 bp, Homo sapiens; identical to SEQ ID NO: 2164

SEQ ID NO: 2878 - DNA, 60 bp, Homo sapiens
agccacaggtggatgctcagatgctatggctctcgcaggcatatcctgcaggtatggtca

SEQ ID NO: 2879 - DNA, 60 bp, Homo sapiens; identical to SEQ ID NO: 2165

SEQ ID NO: 2880 - DNA, 60 bp, Homo sapiens
ctatgtactgaatttagaggttgagaataataggatctgtgttattcttagtacccactg

SEQ ID NO: 2881 - DNA, 60 bp, Homo sapiens; identical to SEQ ID NO: 1400

SEQ ID NO: 2882 - DNA, 60 bp, Homo sapiens; identical to SEQ ID NO: 805

SEQ ID NO: 2883 - DNA, 60 bp, Homo sapiens
gaacctgcattagttccagcaatgaaagtaagacacacagcatatgacataagacacagt

SEQ ID NO: 2884 - DNA, 60 bp, Homo sapiens; identical to SEQ ID NO: 1404

SEQ ID NO: 2885 - DNA, 60 bp, Homo sapiens; identical to SEQ ID NO: 1408

SEQ ID NO: 2886 - DNA, 60 bp, Homo sapiens; identical to SEQ ID NO: 807

SEQ ID NO: 2887 - DNA, 60 bp, Homo sapiens; identical to SEQ ID NO: 1412

SEQ ID NO: 2888 - DNA, 60 bp, Homo sapiens
ggatgtatcgatttagagaaccaattaatacctgcaaaataaagcatactgtggtacttc

SEQ ID NO: 2889 - DNA, 60 bp, Homo sapiens
gcattcttgtagtgagcagtgtatggtctcttttgttcagaatttaaaactgataaccaa

SEQ ID NO: 2890 - DNA, 60 bp, Homo sapiens
cacttggttggttgtattgtagctattacttatacagcaacatttcttcaattagcagtc

SEQ ID NO: 2891 - DNA, 60 bp, Homo sapiens; identical to SEQ ID NO: 1414

SEQ ID NO: 2892 - DNA, 60 bp, Homo sapiens; identical to SEQ ID NO: 1415

SEQ ID NO: 2893 - DNA, 60 bp, Homo sapiens; identical to SEQ ID NO: 809

SEQ ID NO: 2894 - DNA, 60 bp, Homo sapiens; identical to SEQ ID NO: 1418

SEQ ID NO: 2895 - DNA, 60 bp, Homo sapiens; identical to SEQ ID NO: 1419

SEQ ID NO: 2896 - DNA, 60 bp, Homo sapiens
cttatccaggtttgcaaatgtacatgttcatttgaatgtaaatcaccatttcttggaacc

SEQ ID NO: 2897 - DNA, 60 bp, Homo sapiens
taacatgttgaaatgtcacattagtagtaaagtggggtttatttatatagtggttaagaa

SEQ ID NO: 2898 - DNA, 60 bp, Homo sapiens
tcaaatggttcttttatactgtggatgatacaggactctgttacctaagatgtgataagc

SEQ ID NO: 2899 - DNA, 60 bp, Homo sapiens; identical to SEQ ID NO: 1421

SEQ ID NO: 2900 - DNA, 60 bp, Homo sapiens; identical to SEQ ID NO: 812

SEQ ID NO: 2901 - DNA, 60 bp, Homo sapiens
agaaacaaaacataaaaaccccaaaactatcacttggaattagcaatatcacccaactgg

SEQ ID NO: 2902 - DNA, 60 bp, Homo sapiens; identical to SEQ ID NO: 1427

SEQ ID NO: 2903 - DNA, 60 bp, Homo sapiens
agaaagtttcaggatttctctggacaagatcctaacattttactgagtcatcttttggcc

SEQ ID NO: 2904 - DNA, 60 bp, Homo sapiens; identical to SEQ ID NO: 1428

SEQ ID NO: 2905 - DNA, 60 bp, Homo sapiens
atcacaacagtctgtcaattaaggaattgctcatattctcgtcaataaagagcaaactcg

SEQ ID NO: 2906 - DNA, 60 bp, Homo sapiens
tcgtgaacacatttattgttaccaatggacaatgagttcattaagactgttcaactaggt

SEQ ID NO: 2907 - DNA, 60 bp, Homo sapiens; identical to SEQ ID NO: 1434

SEQ ID NO: 2908 - DNA, 60 bp, Homo sapiens; identical to SEQ ID NO: 1435

SEQ ID NO: 2909 - DNA, 60 bp, Homo sapiens; identical to SEQ ID NO: 1436

SEQ ID NO: 2910 - DNA, 60 bp, Homo sapiens; identical to SEQ ID NO: 1438

SEQ ID NO: 2911 - DNA, 60 bp, Homo sapiens; identical to SEQ ID NO: 1439

SEQ ID NO: 2912 - DNA, 60 bp, Homo sapiens
gaattttgttacactggaggaaggggagaccttgaggaatatggtcaggatcttctccat

SEQ ID NO: 2913 - DNA, 60 bp, Homo sapiens
cagtggtgtaactcaatacatggtcatttttattctcatattttcaggtaagtgaaaggg

SEQ ID NO: 2914 - DNA, 60 bp, Homo sapiens; identical to SEQ ID NO: 1444

SEQ ID NO: 2915 - DNA, 60 bp, Homo sapiens; identical to SEQ ID NO: 1445

SEQ ID NO: 2916 - DNA, 60 bp, Homo sapiens
gctgcccgcatctatgattacgaccccctatataaggaggcgctgcaaatgctgcgggat

SEQ ID NO: 2917 - DNA, 60 bp, Homo sapiens; identical to SEQ ID NO: 1446

SEQ ID NO: 2918 - DNA, 60 bp, Homo sapiens; identical to SEQ ID NO: 1447

SEQ ID NO: 2919 - DNA, 60 bp, Homo sapiens
taagcagaaaagccacgatgatattatcgttcctgagtttggtgattcagctcgctttcc

SEQ ID NO: 2920 - DNA, 60 bp, Homo sapiens; identical to SEQ ID NO: 1449

SEQ ID NO: 2921 - DNA, 60 bp, Homo sapiens; identical to SEQ ID NO: 821

SEQ ID NO: 2922 - DNA, 60 bp, Homo sapiens
gtgtggaaacatctatcctatagatcatcctattcttatgtgtctttggttatcagatca

SEQ ID NO: 2923 - DNA, 60 bp, Homo sapiens; identical to SEQ ID NO: 2221

SEQ ID NO: 2924 - DNA, 60 bp, Homo sapiens
gtctgagcacatttactgacttgaacaaggaccatcattggtcttttgtccagaatttgc

SEQ ID NO: 2925 - DNA, 60 bp, Homo sapiens; identical to SEQ ID NO: 1454

SEQ ID NO: 2926 - DNA, 60 bp, Homo sapiens; identical to SEQ ID NO: 1458

SEQ ID NO: 2927 - DNA, 60 bp, Homo sapiens
ttttcccttttgctaaatgcttaggtatttgctatagctgtttctgatgtcatggattct

SEQ ID NO: 2928 - DNA, 60 bp, Homo sapiens; identical to SEQ ID NO: 1459

SEQ ID NO: 2929 - DNA, 60 bp, Homo sapiens; identical to SEQ ID NO: 1461

SEQ ID NO: 2930 - DNA, 60 bp, Homo sapiens; identical to SEQ ID NO: 1463

SEQ ID NO: 2931 - DNA, 60 bp, Homo sapiens; identical to SEQ ID NO: 827

SEQ ID NO: 2932 - DNA, 60 bp, Homo sapiens; identical to SEQ ID NO: 1469

SEQ ID NO: 2933 - DNA, 60 bp, Homo sapiens; identical to SEQ ID NO: 1470

SEQ ID NO: 2934 - DNA, 60 bp, Homo sapiens; identical to SEQ ID NO: 1471

SEQ ID NO: 2935 - DNA, 60 bp, Homo sapiens
gcatcatattcggaaatatcttcctaggtttatctaccatttagtgttgtttagtcagac

SEQ ID NO: 2936 - DNA, 60 bp, Homo sapiens; identical to SEQ ID NO: 1473

SEQ ID NO: 2937 - DNA, 60 bp, Homo sapiens
ttccttgtttactggtttgactataattctctgttatctttacgaggtaaaactgcaagc

SEQ ID NO: 2938 - DNA, 60 bp, Homo sapiens
ggccagaatacccaaaattattcacacgacgttaacttattggtactggctaagcaatac

SEQ ID NO: 2939 - DNA, 60 bp, Homo sapiens; identical to SEQ ID NO: 2241

SEQ ID NO: 2940 - DNA, 60 bp, Homo sapiens; identical to SEQ ID NO: 1475

SEQ ID NO: 2941 - DNA, 60 bp, Homo sapiens
gaaagatacatgcattctatggtaacaactactgtcaataacatctgatgttacatgcac

SEQ ID NO: 2942 - DNA, 60 bp, Homo sapiens; identical to SEQ ID NO: 1476

SEQ ID NO: 2943 - DNA, 60 bp, Homo sapiens; identical to SEQ ID NO: 1477

SEQ ID NO: 2944 - DNA, 60 bp, Homo sapiens; identical to SEQ ID NO: 1478

SEQ ID NO: 2945 - DNA, 60 bp, Homo sapiens; identical to SEQ ID NO: 1480

SEQ ID NO: 2946 - DNA, 60 bp, Homo sapiens
tggattctcatggtaggatttctgagatcttaatctaagctccaaagttgtctacttttt

SEQ ID NO: 2947 - DNA, 60 bp, Homo sapiens
aaacagatgtgtcataatattaactgtcctaaagaacatgtgtcttgcaaatgccatgga

SEQ ID NO: 2948 - DNA, 60 bp, Homo sapiens
aaagtacaatagaatttctggagtacagattaaactatttgcactaacacacgtgacgtg

SEQ ID NO: 2949 - DNA, 60 bp, Homo sapiens
ttggctcttattaggtattgtaaatagtagggttatatcgatatcagcttttgtgatggc

SEQ ID NO: 2950 - DNA, 60 bp, Homo sapiens
gtggatctcttagttggtcacttaattctttctttttcagaaagatagtatgttcactgg

SEQ ID NO: 2951 - DNA, 60 bp, Homo sapiens
aagagtggcagaggctactacaaaaagcaaccttttcattttcactaagagtttaaaagc

SEQ ID NO: 2952 - DNA, 60 bp, Homo sapiens; identical to SEQ ID NO: 1484

SEQ ID NO: 2953 - DNA, 60 bp, Homo sapiens
gtgtggagattggatcaactgagttgtgttatttttgttttaagtcacgttgtgcgagaa

SEQ ID NO: 2954 - DNA, 60 bp, Homo sapiens
aaagtgtgaataactgatagtcattgctgtatcattgatgtatcactcaatttttggtaa

SEQ ID NO: 2955 - DNA, 60 bp, Homo sapiens
tcgtgcgttgccttgctccgtttttcccaaaaagcactggcttcatcaaggccaccgacg

SEQ ID NO: 2956 - DNA, 60 bp, Homo sapiens
cgtgggaggtgttgatgatggtctctatgttgcgttccagctgcgacattttgcaagtca

SEQ ID NO: 2957 - DNA, 60 bp, Homo sapiens; identical to SEQ ID NO: 1492

SEQ ID NO: 2958 - DNA, 60 bp, Homo sapiens; identical to SEQ ID NO: 1495

SEQ ID NO: 2959 - DNA, 60 bp, Homo sapiens
ttctcaaaaaatgttttcgtcacaacctggcgtgaatgcttttctccggagaaacactga

SEQ ID NO: 2960 - DNA, 60 bp, Homo sapiens; identical to SEQ ID NO: 1496

SEQ ID NO: 2961 - DNA, 60 bp, Homo sapiens
atgactgtaagatcttgagagtatgttcttactcatttctgtaattgcagtagtgtagtc

SEQ ID NO: 2962 - DNA, 60 bp, Homo sapiens
attaattctgactaaatggcattaaaggaggtctgaggaatttgcatgtcacattctgga

SEQ ID NO: 2963 - DNA, 60 bp, Homo sapiens
aactgctacaaatggtctcctttaagcagtgtctgctaataatgtcatcacttttcactt

SEQ ID NO: 2964 - DNA, 60 bp, Homo sapiens; identical to SEQ ID NO: 1499

SEQ ID NO: 2965 - DNA, 60 bp, Homo sapiens; identical to SEQ ID NO: 1501

SEQ ID NO: 2966 - DNA, 60 bp, Homo sapiens
agtcttctagatttctgctagcaaactgatatgaggtagagtcctgaaagatctttcagc

SEQ ID NO: 2967 - DNA, 60 bp, Homo sapiens; identical to SEQ ID NO: 1503

SEQ ID NO: 2968 - DNA, 60 bp, Homo sapiens
tttagacaacatttgtagacacctcaaattatatcactgttctctagcgccaatattccc

SEQ ID NO: 2969 - DNA, 60 bp, Homo sapiens
tcagaaaaaacagagtaaggcaccactcttgggaaattaaggtagcttgcagtaacaagt

SEQ ID NO: 2970 - DNA, 60 bp, Homo sapiens; identical to SEQ ID NO: 1511

SEQ ID NO: 2971 - DNA, 60 bp, Homo sapiens
gtaaagctgtggaattctgttgatgatggatgtgagagtggtgaagccctgcgggatgat

SEQ ID NO: 2972 - DNA, 60 bp, Homo sapiens; identical to SEQ ID NO: 1513

SEQ ID NO: 2973 - DNA, 60 bp, Homo sapiens
ggttgacttgactcatgcttgtttcactttcacatggaatttcccagttatgaaattaat

SEQ ID NO: 2974 - DNA, 60 bp, Homo sapiens; identical to SEQ ID NO: 843

SEQ ID NO: 2975 - DNA, 60 bp, Homo sapiens; identical to SEQ ID NO: 1519

SEQ ID NO: 2976 - DNA, 60 bp, Homo sapiens
atacattttaattcctcacgttttatattggagagttcggtacagactgtccattactgc

SEQ ID NO: 2977 - DNA, 60 bp, Homo sapiens; identical to SEQ ID NO: 1520

SEQ ID NO: 2978 - DNA, 60 bp, Homo sapiens; identical to SEQ ID NO: 1521

SEQ ID NO: 2979 - DNA, 60 bp, Homo sapiens
gatttaactgttcttagatctttcttacacagtgattcattcctctatttgtacagtggc

SEQ ID NO: 2980 - DNA, 60 bp, Homo sapiens; identical to SEQ ID NO: 846

SEQ ID NO: 2981 - DNA, 60 bp, Homo sapiens; identical to SEQ ID NO: 1523

SEQ ID NO: 2982 - DNA, 60 bp, Homo sapiens; identical to SEQ ID NO: 847

SEQ ID NO: 2983 - DNA, 60 bp, Homo sapiens; identical to SEQ ID NO: 1526

SEQ ID NO: 2984 - DNA, 60 bp, Homo sapiens; identical to SEQ ID NO: 2295

SEQ ID NO: 2985 - DNA, 60 bp, Homo sapiens; identical to SEQ ID NO: 1528

SEQ ID NO: 2986 - DNA, 60 bp, Homo sapiens; identical to SEQ ID NO: 1529

SEQ ID NO: 2987 - DNA, 60 bp, Homo sapiens
aagctctgttgctgtggtaggcattcagttattcctaatagtttattttaggtactatac

SEQ ID NO: 2988 - DNA, 60 bp, Homo sapiens
caatgtgacagtgttacatttggagagaagtgtgaaatctaaccaatcgctagcacatat

SEQ ID NO: 2989 - DNA, 60 bp, Homo sapiens; identical to SEQ ID NO: 1532

SEQ ID NO: 2990 - DNA, 60 bp, Homo sapiens
gttagatcaccatgctgcaacatggtttatattcatgctgccctagaaacttttgtaatt

SEQ ID NO: 2991 - DNA, 60 bp, Homo sapiens; identical to SEQ ID NO: 848

SEQ ID NO: 2992 - DNA, 60 bp, Homo sapiens; identical to SEQ ID NO: 1535

SEQ ID NO: 2993 - DNA, 60 bp, Homo sapiens; identical to SEQ ID NO: 1536

SEQ ID NO: 2994 - DNA, 60 bp, Homo sapiens; identical to SEQ ID NO: 1538

SEQ ID NO: 2995 - DNA, 60 bp, Homo sapiens
cacgtgtctatttctgtagacctatctccttagatttgtacatgcattttttgcggactt

SEQ ID NO: 2996 - DNA, 60 bp, Homo sapiens; identical to SEQ ID NO: 851

SEQ ID NO: 2997 - DNA, 60 bp, Homo sapiens
aaaccacctacctaatctgactgctaaatttctagcttctttgttttaaatatgctcagg

SEQ ID NO: 2998 - DNA, 60 bp, Homo sapiens
atttaactgaggtagaccagatgtttctaaattcggggtttcatagaatcccctgaatct

SEQ ID NO: 2999 - DNA, 60 bp, Homo sapiens; identical to SEQ ID NO: 855

SEQ ID NO: 3000 - DNA, 60 bp, Homo sapiens
ctctacatccttacctaggtaattcaggcatgcgccagtattttggaggggtccaaatta

SEQ ID NO: 3001 - DNA, 60 bp, Homo sapiens; identical to SEQ ID NO: 1550

SEQ ID NO: 3002 - DNA, 60 bp, Homo sapiens
ctgtcctattccagccctagtgaatagataatgccttgaactattcctatcaccacaggt

SEQ ID NO: 3003 - DNA, 60 bp, Homo sapiens; identical to SEQ ID NO: 856

SEQ ID NO: 3004 - DNA, 60 bp, Homo sapiens; identical to SEQ ID NO: 1553

SEQ ID NO: 3005 - DNA, 60 bp, Homo sapiens; identical to SEQ ID NO: 857

SEQ ID NO: 3006 - DNA, 60 bp, Homo sapiens
cattagggaaagtttcgtgggtgcattagagttcaagtttgttggctcattgtaggactg

SEQ ID NO: 3007 - DNA, 60 bp, Homo sapiens; identical to SEQ ID NO: 860

SEQ ID NO: 3008 - DNA, 60 bp, Homo sapiens; identical to SEQ ID NO: 1558

SEQ ID NO: 3009 - DNA, 60 bp, Homo sapiens
aaagtgtggtattgaaagatgtacaactgactttggaaaaaggattcctctctaattggt

SEQ ID NO: 3010 - DNA, 60 bp, Homo sapiens; identical to SEQ ID NO: 861

SEQ ID NO: 3011 - DNA, 60 bp, Homo sapiens; identical to SEQ ID NO: 862

SEQ ID NO: 3012 - DNA, 60 bp, Homo sapiens; identical to SEQ ID NO: 1562

SEQ ID NO: 3013 - DNA, 60 bp, Homo sapiens
atgtaatgaatgtcagaaagcctttggtgataggtcagctctaaaagtacatcagagaat

SEQ ID NO: 3014 - DNA, 60 bp, Homo sapiens
gataggattcttaacagtaagctctttataattcaacaatgtgatctttactcctacccc

SEQ ID NO: 3015 - DNA, 60 bp, Homo sapiens; identical to SEQ ID NO: 1567

SEQ ID NO: 3016 - DNA, 60 bp, Homo sapiens; identical to SEQ ID NO: 863

SEQ ID NO: 3017 - DNA, 60 bp, Homo sapiens
agaaaaagaacagaagtctggggtcccacacatactatgtttccagatgactgtattttt

SEQ ID NO: 3018 - DNA, 60 bp, Homo sapiens
ttactgagtgtttcagagtgtgtttggtttgagcaggtctagggtgattgaacatccctg

SEQ ID NO: 3019 - DNA, 60 bp, Homo sapiens; identical to SEQ ID NO: 1570

SEQ ID NO: 3020 - DNA, 60 bp, Homo sapiens; identical to SEQ ID NO: 864

SEQ ID NO: 3021 - DNA, 60 bp, Homo sapiens
agaagtgaaaaactgaagaatgtggagtgtttactgtcccgttactcacacagacgtgct

SEQ ID NO: 3022 - DNA, 60 bp, Homo sapiens
agggccgattatctttacataggacgccagcagggaattttgttacactggaagaaggaa

SEQ ID NO: 3023 - DNA, 60 bp, Homo sapiens; identical to SEQ ID NO: 865

SEQ ID NO: 3024 - DNA, 60 bp, Homo sapiens
accatctgctgggacgggacaccctctcttcttgatctcactcccagaaaagacactgaa

SEQ ID NO: 3025 - DNA, 60 bp, Homo sapiens
caaatagtccttcaaagcatcttcagaatcaagattgtcatctagattgcacccgaagtt

SEQ ID NO: 3026 - DNA, 60 bp, Homo sapiens; identical to SEQ ID NO: 1574

SEQ ID NO: 3027 - DNA, 60 bp, Homo sapiens
taaaatgcttgcacaactccactgtcattctcagagatttccattgggaagccatgccta

SEQ ID NO: 3028 - DNA, 60 bp, Homo sapiens
atttatatacacgatggggcagcctaatgcacatcataacattaacttttccaaagaagt

SEQ ID NO: 3029 - DNA, 60 bp, Homo sapiens
acactttgccatggtcaaagaatgaaggacaatatggaaaagccaatcttcaaatatatc

SEQ ID NO: 3030 - DNA, 60 bp, Homo sapiens; identical to SEQ ID NO: 1601

SEQ ID NO: 3031 - DNA, 60 bp, Homo sapiens; identical to SEQ ID NO: 190

SEQ ID NO: 3032 - DNA, 60 bp, Homo sapiens
cccgccctcacattctcattggcgtggatgccaagaccacgtccacctgtcaggaaaaaa

SEQ ID NO: 3033 - DNA, 60 bp, Homo sapiens; identical to SEQ ID NO: 442

SEQ ID NO: 3034 - DNA, 60 bp, Homo sapiens; identical to SEQ ID NO: 904

SEQ ID NO: 3035 - DNA, 60 bp, Homo sapiens; identical to SEQ ID NO: 457

SEQ ID NO: 3036 - DNA, 60 bp, Homo sapiens; identical to SEQ ID NO: 466

SEQ ID NO: 3037 - DNA, 60 bp, Homo sapiens
ccgccgcaaccacatccgaagaaaggggtcaggtattctaggcgtacggggactgataaa

SEQ ID NO: 3038 - DNA, 60 bp, Homo sapiens
aagaagggacagttacacagtaattgggaaaacttctgcaaggacagatgtgcatttctc

SEQ ID NO: 3039 - DNA, 60 bp, Homo sapiens; identical to SEQ ID NO: 506

SEQ ID NO: 3040 - DNA, 60 bp, Homo sapiens
acacctactacagctgagaactactatagttgagtaactttgggatgtggagtaggccca

SEQ ID NO: 3041 - DNA, 60 bp, Homo sapiens; identical to SEQ ID NO: 935

SEQ ID NO: 3042 - DNA, 60 bp, Homo sapiens; identical to SEQ ID NO: 538

SEQ ID NO: 3043 - DNA, 60 bp, Homo sapiens; identical to SEQ ID NO: 554

SEQ ID NO: 3044 - DNA, 60 bp, Homo sapiens; identical to SEQ ID NO: 1169

SEQ ID NO: 3045 - DNA, 60 bp, Homo sapiens; identical to SEQ ID NO: 1216

SEQ ID NO: 3046 - DNA, 60 bp, Homo sapiens
actatttcttcagagtttgtcatatactgcttgtcatctgcatgtctactcagcatttga

SEQ ID NO: 3047 - DNA, 60 bp, Homo sapiens; identical to SEQ ID NO: 1224

SEQ ID NO: 3048 - DNA, 60 bp, Homo sapiens; identical to SEQ ID NO: 730

SEQ ID NO: 3049 - DNA, 60 bp, Homo sapiens; identical to SEQ ID NO: 753

SEQ ID NO: 3050 - DNA, 60 bp, Homo sapiens; identical to SEQ ID NO: 763

SEQ ID NO: 3051 - DNA, 60 bp, Homo sapiens; identical to SEQ ID NO: 1310

SEQ ID NO: 3052 - DNA, 60 bp, Homo sapiens; identical to SEQ ID NO: 781

SEQ ID NO: 3053 - DNA, 60 bp, Homo sapiens; identical to SEQ ID NO: 1354

SEQ ID NO: 3054 - DNA, 60 bp, Homo sapiens; identical to SEQ ID NO: 1380

SEQ ID NO: 3055 - DNA, 60 bp, Homo sapiens
cccccgccgaattcttttagcttcgtaattggaacctttgacctgatctaaagtggactt

SEQ ID NO: 3056 - DNA, 60 bp, Homo sapiens
tcctcccccagagatctggctggagcccagaaaaagaagcatgtggtttaaaaaatgttt

SEQ ID NO: 3057 - DNA, 60 bp, Homo sapiens
ccagccgccccccaggtggcctcacattctgctctgctaagtttggagaaaacagaacaa

SEQ ID NO: 3058 - DNA, 60 bp, Homo sapiens
tccccctcaactgagaactcaagtcagctggacttcgaagatgtatggaattcttcctat

SEQ ID NO: 3059 - DNA, 60 bp, Homo sapiens
attagctaggatctactagatgcattatactccatacctgcttttcccatggccgcccta

SEQ ID NO: 3060 - DNA, 60 bp, Homo sapiens
gacgccccccagactcacacgggggcttatttattgctttatttatttacttattcattt

SEQ ID NO: 3061 - DNA, 60 bp, Homo sapiens
accccccagctttctttctacagatggtgctactcttggtctcccacaggaaaaggcctc

SEQ ID NO: 3062 - DNA, 60 bp, Homo sapiens
tgctcccacgcctgcttcttaaggtccctgctcggccggtgtaaatatgtttcaccctgt

SEQ ID NO: 3063 - DNA, 60 bp, Homo sapiens
ccccccaaactggaagaagaaggagaagctaccccaggtctccaagtcctggcataacta

SEQ ID NO: 3064 - DNA, 60 bp, Homo sapiens
ttcgcccctcccttgttttatattttatgaagttagtgcgggctttgctgctccctggcc

SEQ ID NO: 3065 - DNA, 60 bp, Homo sapiens
tgaatcccccataaacaccagatgattgagtctaccttctttccttggcccgctcccttt

SEQ ID NO: 3066 - DNA, 60 bp, Homo sapiens
caaagtccccccggcttgctatgatgcctgacaactaaatatccttatccaaatcaataa

SEQ ID NO: 3067 - DNA, 60 bp, Homo sapiens
cgtgatcataggcatcactattgcctccgtggttggacttcttgtcatcttttctgctat

SEQ ID NO: 3068 - DNA, 60 bp, Homo sapiens
ctcccctgcgccttttcatgctagggagatgcatcctagttgtcctcctggcagctgttt

SEQ ID NO: 3069 - DNA, 60 bp, Homo sapiens
tcctcctgcaactgtggtttgaaactgcgcattctctagtagtatatatcgtgcctgtct

SEQ ID NO: 3070 - DNA, 60 bp, Homo sapiens
ccacccccacatctttctttgtcctatacatgtcttccatttggctgtttctgagttgta

SEQ ID NO: 3071 - DNA, 60 bp, Homo sapiens
gcccgccaccacacctggctaattttttaaaaatatttttagtagagacagggtttcact

SEQ ID NO: 3072 - DNA, 60 bp, Homo sapiens; identical to SEQ ID NO: 131

SEQ ID NO: 3073 - DNA, 60 bp, Homo sapiens
ccaccccactgcccccaccttaatgtgaatttgactgatgaatgaagagcgtttctaata

SEQ ID NO: 3074 - DNA, 60 bp, Homo sapiens
cgacgccgcctacgtcttcgaggaccctttcaacatccacgacttaaaggtcaacgtgga

SEQ ID NO: 3075 - DNA, 60 bp, Homo sapiens; identical to SEQ ID NO: 179

SEQ ID NO: 3076 - DNA, 60 bp, Homo sapiens; identical to SEQ ID NO: 1601

SEQ ID NO: 3077 - DNA, 60 bp, Homo sapiens; identical to SEQ ID NO: 876

SEQ ID NO: 3078 - DNA, 60 bp, Homo sapiens
cccccctccgatgcatgctcttctctcacatggagaaaaccaagacagaattgggaagcc

SEQ ID NO: 3079 - DNA, 60 bp, Homo sapiens
cccccgctaccaccaacggctaccaaccacgacaggcttcaccgggacccgtccggccaa

SEQ ID NO: 3080 - DNA, 60 bp, Homo sapiens
ccccgcctcatctggaaatagttccgtttgtttctctaaaaagacttgtaggtgggaaaa

SEQ ID NO: 3081 - DNA, 60 bp, Homo sapiens
tcccctactccccgcatctttggggaatcggttccccatatgtcttccttactagactgt

SEQ ID NO: 3082 - DNA, 60 bp, Homo sapiens
actcttcctgggaatcaatttttgatttccctgttattgatctgataacactctccccaa

SEQ ID NO: 3083 - DNA, 60 bp, Homo sapiens
cctccccacgatgggtgccaacgtctctcaggacaatggcactggccacaatgccacctt

SEQ ID NO: 3084 - DNA, 60 bp, Homo sapiens; identical to SEQ ID NO: 220

SEQ ID NO: 3085 - DNA, 60 bp, Homo sapiens
cccaccccttcttttggagcagagccaagcaactccagttcttccaggacgtcagtgact

SEQ ID NO: 3086 - DNA, 60 bp, Homo sapiens
cggagtttgatgaggatttcgaggaggaacccacatcccccataggtcactgtgtggcca

SEQ ID NO: 3087 - DNA, 60 bp, Homo sapiens
ggtacctgtcccccctcaaaacccacaggttcctttcttttccatccaacaattaaagat

SEQ ID NO: 3088 - DNA, 60 bp, Homo sapiens
agtcctatgtacttcttcctcagaaacttgtccttcctggagataggtttcaacttggtc

SEQ ID NO: 3089 - DNA, 60 bp, Homo sapiens; identical to SEQ ID NO: 1614

SEQ ID NO: 3090 - DNA, 60 bp, Homo sapiens
ccctcctggggccaggccgggcctgtacagtctgtcttctgtatatacatgggaacattt

SEQ ID NO: 3091 - DNA, 60 bp, Homo sapiens
cttcccacccctctcttctagcttggtaatgaagtatatttattggtgaaggaaacagct

SEQ ID NO: 3092 - DNA, 60 bp, Homo sapiens
tggcaacctgcgtccggaagccatcactgctatcatcgtggtcttctccctcttggctgc

SEQ ID NO: 3093 - DNA, 60 bp, Homo sapiens
gtgcctgggtcccattcaaactccagcagcggggcttggatcaggcagctttattccaaa

SEQ ID NO: 3094 - DNA, 60 bp, Homo sapiens
cccccaccgccaccctacggccacaagcggtaccgccaaaagggcagggagggccactcg

SEQ ID NO: 3095 - DNA, 60 bp, Homo sapiens
cctccctggcctcctcagctgaaccacagtggttttcaaacacaggtgccccagggcaca

SEQ ID NO: 3096 - DNA, 60 bp, Homo sapiens
cccaggagccccctgccggaaccgcctgcgccatcgcgggctggggcgccctcttcgaag

SEQ ID NO: 3097 - DNA, 60 bp, Homo sapiens; identical to SEQ ID NO: 3032

SEQ ID NO: 3098 - DNA, 60 bp, Homo sapiens
cctccctccacacagacccgctcaggacggcttttctgtatggcagatctttctcagaag

SEQ ID NO: 3099 - DNA, 60 bp, Homo sapiens
tctcgcatctgcccccgtcctacgaggctgccgtgaaatccgagctgaaccgctactctt

SEQ ID NO: 3100 - DNA, 60 bp, Homo sapiens
cctacccgccccagtcgtccctggagagacctgcctgaaactggagtctggccccctgaa

SEQ ID NO: 3101 - DNA, 60 bp, Homo sapiens
tccccccacccccagcatggcttggaagactgaaaggcatagagggattcttttgctgca

SEQ ID NO: 3102 - DNA, 60 bp, Homo sapiens
cccttccccactctggcgccctggacaggcaccaggactccccggtaaccagtctcagaa

SEQ ID NO: 3103 - DNA, 60 bp, Homo sapiens
ccacccccttccccatagagcttctacccttggggtattcggagcctgcctttgggcctt

SEQ ID NO: 3104 - DNA, 60 bp, Homo sapiens
ggatgcccccgccgccaagcccctggccagcgcgcctggcggaccgggctgcggcccagg

SEQ ID NO: 3105 - DNA, 60 bp, Homo sapiens
acacccctccgttccgctagcctaccctgtcagcctttcaataaaagttatgcacaaatg

SEQ ID NO: 3106 - DNA, 60 bp, Homo sapiens
tgtgcccagccccatggtggtcgcagccaccaccgactcggccgcggagaaagccccggc

SEQ ID NO: 3107 - DNA, 60 bp, Homo sapiens
gccgccattcatcatcctctctctcctcacatgcgtctagtgaagcaggaaacatggtga

SEQ ID NO: 3108 - DNA, 60 bp, Homo sapiens
catccccgccccacagcaaggcggcccctggagacgtgaaggtcaaggaggagcgcgggg

SEQ ID NO: 3109 - DNA, 60 bp, Homo sapiens
ctctctccccgttgtactcatcaattctgccagtaaaaattctcctctatgacctggaaa

SEQ ID NO: 3110 - DNA, 60 bp, Homo sapiens
cacccgacctccctacgaacaacaatgacgacctgctttctctgtttgagaacaactgat

SEQ ID NO: 3111 - DNA, 60 bp, Homo sapiens
agaacacagaggagcccccccacccaatcaaggtcattggtcttcaagataaagtgccta

SEQ ID NO: 3112 - DNA, 60 bp, Homo sapiens
tatcacgctcctcccacacccaccctggcttccatcatgagtgcagtgtcatctcagcgg

SEQ ID NO: 3113 - DNA, 60 bp, Homo sapiens
accgccgcgccaaggcaaagagactacaagaggcagagctggagaagctgaagatggccg

SEQ ID NO: 3114 - DNA, 60 bp, Homo sapiens
cctccctcctctcaaactctccagtgtggtgtgaactcagaagaaacggttactggggct

SEQ ID NO: 3115 - DNA, 60 bp, Homo sapiens
ggaggcttcatgcattcctttgcacaaatccttctcatcttccacctgctcttctgtggc

SEQ ID NO: 3116 - DNA, 60 bp, Homo sapiens
taccgcccctcctatgaagagatgctgcgattctacagttactacaagcaggccaccatg

SEQ ID NO: 3117 - DNA, 60 bp, Homo sapiens; identical to SEQ ID NO: 2403

SEQ ID NO: 3118 - DNA, 60 bp, Homo sapiens
cgcagctccgcccaccgctcacggagtccgggcgggcaccgacaccgcccaaatccccgc

SEQ ID NO: 3119 - DNA, 60 bp, Homo sapiens
tcctctctcctccagctctccccatcatgaaataattctgataacgacacatggactttg

SEQ ID NO: 3120 - DNA, 60 bp, Homo sapiens
cccacccccttctcgcgctctccaactgcctttcacctagaagcgctccacgcgtgcgcc

SEQ ID NO: 3121 - DNA, 60 bp, Homo sapiens
ctcgcccgccaagcccagctccttggacctggtgcccaacctgcccaagggggctctccc

SEQ ID NO: 3122 - DNA, 60 bp, Homo sapiens; identical to SEQ ID NO: 2405

SEQ ID NO: 3123 - DNA, 60 bp, Homo sapiens
atccaccccggcccggaagagaccactgcgagcgcctcaaccccaggccggcaatcctag

SEQ ID NO: 3124 - DNA, 60 bp, Homo sapiens
cacttccgccgcctcgactacttctcagaagagaggagcgcccgggacctgctcaagcgc

SEQ ID NO: 3125 - DNA, 60 bp, Homo sapiens; identical to SEQ ID NO: 1631

SEQ ID NO: 3126 - DNA, 60 bp, Homo sapiens
cgccctccccacaacaccaaagaccagaacccagctcctcactgcatccccgacgccctc

SEQ ID NO: 3127 - DNA, 60 bp, Homo sapiens
gccccaccctctccagacaggcaccaggctgtggtgacccgcctctcagcagctcctcct

SEQ ID NO: 3128 - DNA, 60 bp, Homo sapiens
tccagccgcgcccacctgcgatccccattggcaagagcccggctcagacaaagaccccgc

SEQ ID NO: 3129 - DNA, 60 bp, Homo sapiens
cagtccccacccccacagcagcaaagtcagccccagcattgacacccagcagtgggggcc

SEQ ID NO: 3130 - DNA, 60 bp, Homo sapiens
ctgccctgcccgcacgacgccatcctgcaagaaatgaggactgagcactgccgcagctcg

SEQ ID NO: 3131 - DNA, 60 bp, Homo sapiens
cagaacgcccccgacaagaagatcacgctcaatgggatttaccagttcatcatggaccgc

SEQ ID NO: 3132 - DNA, 60 bp, Homo sapiens
tcctggacctattatgggtcctcatctcttcctgggaacgtccagcttgcctggctctca

SEQ ID NO: 3133 - DNA, 60 bp, Homo sapiens; identical to SEQ ID NO: 1644

SEQ ID NO: 3134 - DNA, 60 bp, Homo sapiens
gccccgcccgacgtgcgcgacacctggtacacgcgggacgtcaccgagctggaggagccc

SEQ ID NO: 3135 - DNA, 60 bp, Homo sapiens; identical to SEQ ID NO: 466

SEQ ID NO: 3136 - DNA, 60 bp, Homo sapiens
gtgttttttcccccctccagaatctaagagcgatagcgtttctccaaataaaccgccaat

SEQ ID NO: 3137 - DNA, 60 bp, Homo sapiens
cccagcccgaagagctgctccaccttcagatactgggcagccctctgcacgctccagccg

SEQ ID NO: 3138 - DNA, 60 bp, Homo sapiens; identical to SEQ ID NO: 3037

SEQ ID NO: 3139 - DNA, 60 bp, Homo sapiens; identical to SEQ ID NO: 2422

SEQ ID NO: 3140 - DNA, 60 bp, Homo sapiens
cccccccttttttttccttaagcataattgtcttaggtttgcctagtttcattttaagaa

SEQ ID NO: 3141 - DNA, 60 bp, Homo sapiens
tgggtggtctgggctaaatgatcaagtgaaacagaaagccaggaaggatctgtgctaatt

SEQ ID NO: 3142 - DNA, 60 bp, Homo sapiens
gggacccaggtctctctctctctcttttcattcatttattcaaaactatgcatccagggc

SEQ ID NO: 3143 - DNA, 60 bp, Homo sapiens
gatcctctgaggtttccaggaagacccccgccctaatcctctgaaggtcggaggtcacag

SEQ ID NO: 3144 - DNA, 60 bp, Homo sapiens; identical to SEQ ID NO: 508

SEQ ID NO: 3145 - DNA, 60 bp, Homo sapiens
ccccccaaccctgtttgtaaggaactaaaacattacatctggtgaacagcaaagatttca

SEQ ID NO: 3146 - DNA, 60 bp, Homo sapiens
acccgagacctgcaccccaatcaaagccattagcaagttctggagtccccgaaaccaaag

SEQ ID NO: 3147 - DNA, 60 bp, Homo sapiens
cgccgcgcgacccccgtctggcggtccccagcccgtggggctcggctctgggggcgggtc

SEQ ID NO: 3148 - DNA, 60 bp, Homo sapiens
aaccccccctgtggcaaacctctacacttgcattaataacatccaacatacgggagaatg

SEQ ID NO: 3149 - DNA, 60 bp, Homo sapiens
gcccccgcatcccagcttggggctgacgccgcagaagacgcacctgcagccgtccttcgg

SEQ ID NO: 3150 - DNA, 60 bp, Homo sapiens
cttccccgtgtccgcgcccctgtactgtcttcacactcgccatcaccttgcacaccctgc

SEQ ID NO: 3151 - DNA, 60 bp, Homo sapiens; identical to SEQ ID NO: 541

SEQ ID NO: 3152 - DNA, 60 bp, Homo sapiens; identical to SEQ ID NO: 2442

SEQ ID NO: 3153 - DNA, 60 bp, Homo sapiens; identical to SEQ ID NO: 556

SEQ ID NO: 3154 - DNA, 60 bp, Homo sapiens; identical to SEQ ID NO: 2456

SEQ ID NO: 3155 - DNA, 60 bp, Homo sapiens; identical to SEQ ID NO: 960

SEQ ID NO: 3156 - DNA, 60 bp, Homo sapiens; identical to SEQ ID NO: 961

SEQ ID NO: 3157 - DNA, 60 bp, Homo sapiens; identical to SEQ ID NO: 2459

SEQ ID NO: 3158 - DNA, 60 bp, Homo sapiens; identical to SEQ ID NO: 2461

SEQ ID NO: 3159 - DNA, 60 bp, Homo sapiens; identical to SEQ ID NO: 2462

SEQ ID NO: 3160 - DNA, 60 bp, Homo sapiens; identical to SEQ ID NO: 561

SEQ ID NO: 3161 - DNA, 60 bp, Homo sapiens; identical to SEQ ID NO: 971

SEQ ID NO: 3162 - DNA, 60 bp, Homo sapiens; identical to SEQ ID NO: 565

SEQ ID NO: 3163 - DNA, 60 bp, Homo sapiens; identical to SEQ ID NO: 568

SEQ ID NO: 3164 - DNA, 60 bp, Homo sapiens; identical to SEQ ID NO: 2475

SEQ ID NO: 3165 - DNA, 60 bp, Homo sapiens; identical to SEQ ID NO: 986

SEQ ID NO: 3166 - DNA, 60 bp, Homo sapiens; identical to SEQ ID NO: 1744

SEQ ID NO: 3167 - DNA, 60 bp, Homo sapiens; identical to SEQ ID NO: 1750

SEQ ID NO: 3168 - DNA, 60 bp, Homo sapiens; identical to SEQ ID NO: 997

SEQ ID NO: 3169 - DNA, 60 bp, Homo sapiens; identical to SEQ ID NO: 998

SEQ ID NO: 3170 - DNA, 60 bp, Homo sapiens; identical to SEQ ID NO: 1000

SEQ ID NO: 3171 - DNA, 60 bp, Homo sapiens; identical to SEQ ID NO: 595

SEQ ID NO: 3172 - DNA, 60 bp, Homo sapiens; identical to SEQ ID NO: 1006

SEQ ID NO: 3173 - DNA, 60 bp, Homo sapiens; identical to SEQ ID NO: 597

SEQ ID NO: 3174 - DNA, 60 bp, Homo sapiens; identical to SEQ ID NO: 1772

SEQ ID NO: 3175 - DNA, 60 bp, Homo sapiens; identical to SEQ ID NO: 602

SEQ ID NO: 3176 - DNA, 60 bp, Homo sapiens
tgtggttagatgcacatggagacaggtatggaagaatatacaccaggctgttaatattga

SEQ ID NO: 3177 - DNA, 60 bp, Homo sapiens; identical to SEQ ID NO: 607

SEQ ID NO: 3178 - DNA, 60 bp, Homo sapiens; identical to SEQ ID NO: 608

SEQ ID NO: 3179 - DNA, 60 bp, Homo sapiens; identical to SEQ ID NO: 1019

SEQ ID NO: 3180 - DNA, 60 bp, Homo sapiens; identical to SEQ ID NO: 1020

SEQ ID NO: 3181 - DNA, 60 bp, Homo sapiens; identical to SEQ ID NO: 1022

SEQ ID NO: 3182 - DNA, 60 bp, Homo sapiens; identical to SEQ ID NO: 1024

SEQ ID NO: 3183 - DNA, 60 bp, Homo sapiens; identical to SEQ ID NO: 1027

SEQ ID NO: 3184 - DNA, 60 bp, Homo sapiens
agccacagctcagagactgggaaacatggttccaaaactgttcacttcccaaatttgtct

SEQ ID NO: 3185 - DNA, 60 bp, Homo sapiens
ttgggtgatgtaaaaccaactccctgccaccaaaataattaaaatagtcacattgttatc

SEQ ID NO: 3186 - DNA, 60 bp, Homo sapiens; identical to SEQ ID NO: 616

SEQ ID NO: 3187 - DNA, 60 bp, Homo sapiens; identical to SEQ ID NO: 618

SEQ ID NO: 3188 - DNA, 60 bp, Homo sapiens; identical to SEQ ID NO: 2545

SEQ ID NO: 3189 - DNA, 60 bp, Homo sapiens; identical to SEQ ID NO: 1798

SEQ ID NO: 3190 - DNA, 60 bp, Homo sapiens; identical to SEQ ID NO: 1042

SEQ ID NO: 3191 - DNA, 60 bp, Homo sapiens; identical to SEQ ID NO: 1043

SEQ ID NO: 3192 - DNA, 60 bp, Homo sapiens; identical to SEQ ID NO: 1046

SEQ ID NO: 3193 - DNA, 60 bp, Homo sapiens; identical to SEQ ID NO: 1050

SEQ ID NO: 3194 - DNA, 60 bp, Homo sapiens; identical to SEQ ID NO: 1056

SEQ ID NO: 3195 - DNA, 60 bp, Homo sapiens; identical to SEQ ID NO: 1059

SEQ ID NO: 3196 - DNA, 60 bp, Homo sapiens; identical to SEQ ID NO: 1062

SEQ ID NO: 3197 - DNA, 60 bp, Homo sapiens; identical to SEQ ID NO: 632

SEQ ID NO: 3198 - DNA, 60 bp, Homo sapiens; identical to SEQ ID NO: 1071

SEQ ID NO: 3199 - DNA, 60 bp, Homo sapiens; identical to SEQ ID NO: 1072

SEQ ID NO: 3200 - DNA, 60 bp, Homo sapiens; identical to SEQ ID NO: 1073

SEQ ID NO: 3201 - DNA, 60 bp, Homo sapiens
ttgcatggaagaaagttgggttcttggcatagagttgcatgatatgtaagattttgtgca

SEQ ID NO: 3202 - DNA, 60 bp, Homo sapiens; identical to SEQ ID NO: 1077

SEQ ID NO: 3203 - DNA, 60 bp, Homo sapiens; identical to SEQ ID NO: 1083

SEQ ID NO: 3204 - DNA, 60 bp, Homo sapiens; identical to SEQ ID NO: 1088

SEQ ID NO: 3205 - DNA, 60 bp, Homo sapiens; identical to SEQ ID NO: 1090

SEQ ID NO: 3206 - DNA, 60 bp, Homo sapiens; identical to SEQ ID NO: 1854

SEQ ID NO: 3207 - DNA, 60 bp, Homo sapiens; identical to SEQ ID NO: 645

SEQ ID NO: 3208 - DNA, 60 bp, Homo sapiens; identical to SEQ ID NO: 1107

SEQ ID NO: 3209 - DNA, 60 bp, Homo sapiens; identical to SEQ ID NO: 654

SEQ ID NO: 3210 - DNA, 60 bp, Homo sapiens; identical to SEQ ID NO: 2620

SEQ ID NO: 3211 - DNA, 60 bp, Homo sapiens; identical to SEQ ID NO: 1111

SEQ ID NO: 3212 - DNA, 60 bp, Homo sapiens; identical to SEQ ID NO: 1112

SEQ ID NO: 3213 - DNA, 60 bp, Homo sapiens; identical to SEQ ID NO: 1114

SEQ ID NO: 3214 - DNA, 60 bp, Homo sapiens; identical to SEQ ID NO: 661

SEQ ID NO: 3215 - DNA, 60 bp, Homo sapiens; identical to SEQ ID NO: 1118

SEQ ID NO: 3216 - DNA, 60 bp, Homo sapiens; identical to SEQ ID NO: 1119

SEQ ID NO: 3217 - DNA, 60 bp, Homo sapiens; identical to SEQ ID NO: 1121

SEQ ID NO: 3218 - DNA, 60 bp, Homo sapiens; identical to SEQ ID NO: 1122

SEQ ID NO: 3219 - DNA, 60 bp, Homo sapiens; identical to SEQ ID NO: 666

SEQ ID NO: 3220 - DNA, 60 bp, Homo sapiens; identical to SEQ ID NO: 1130

SEQ ID NO: 3221 - DNA, 60 bp, Homo sapiens; identical to SEQ ID NO: 1132

SEQ ID NO: 3222 - DNA, 60 bp, Homo sapiens; identical to SEQ ID NO: 1133

SEQ ID NO: 3223 - DNA, 60 bp, Homo sapiens; identical to SEQ ID NO: 672

SEQ ID NO: 3224 - DNA, 60 bp, Homo sapiens; identical to SEQ ID NO: 1136

SEQ ID NO: 3225 - DNA, 60 bp, Homo sapiens
catgtatttaaacctatgaattataaaatagtatttagattctagcgtgagttaaataga

SEQ ID NO: 3226 - DNA, 60 bp, Homo sapiens; identical to SEQ ID NO: 1138

SEQ ID NO: 3227 - DNA, 60 bp, Homo sapiens; identical to SEQ ID NO: 1140

SEQ ID NO: 3228 - DNA, 60 bp, Homo sapiens; identical to SEQ ID NO: 679

SEQ ID NO: 3229 - DNA, 60 bp, Homo sapiens
gatctctttaggatgactgtatttttcagttgccgatacagctttttgtcctctaactgt

SEQ ID NO: 3230 - DNA, 60 bp, Homo sapiens; identical to SEQ ID NO: 1154

SEQ ID NO: 3231 - DNA, 60 bp, Homo sapiens; identical to SEQ ID NO: 1156

SEQ ID NO: 3232 - DNA, 60 bp, Homo sapiens; identical to SEQ ID NO: 1162

SEQ ID NO: 3233 - DNA, 60 bp, Homo sapiens; identical to SEQ ID NO: 689

SEQ ID NO: 3234 - DNA, 60 bp, Homo sapiens; identical to SEQ ID NO: 692

SEQ ID NO: 3235 - DNA, 60 bp, Homo sapiens; identical to SEQ ID NO: 1169

SEQ ID NO: 3236 - DNA, 60 bp, Homo sapiens; identical to SEQ ID NO: 1170

SEQ ID NO: 3237 - DNA, 60 bp, Homo sapiens; identical to SEQ ID NO: 698

SEQ ID NO: 3238 - DNA, 60 bp, Homo sapiens; identical to SEQ ID NO: 701

SEQ ID NO: 3239 - DNA, 60 bp, Homo sapiens; identical to SEQ ID NO: 1179

SEQ ID NO: 3240 - DNA, 60 bp, Homo sapiens; identical to SEQ ID NO: 1184

SEQ ID NO: 3241 - DNA, 60 bp, Homo sapiens; identical to SEQ ID NO: 704

SEQ ID NO: 3242 - DNA, 60 bp, Homo sapiens
tcctggtggtatcatagtgtaattttagtatttgaaaatcagtgtgattccttaatggcc

SEQ ID NO: 3243 - DNA, 60 bp, Homo sapiens; identical to SEQ ID NO: 1186

SEQ ID NO: 3244 - DNA, 60 bp, Homo sapiens; identical to SEQ ID NO: 1188

SEQ ID NO: 3245 - DNA, 60 bp, Homo sapiens; identical to SEQ ID NO: 1191

SEQ ID NO: 3246 - DNA, 60 bp, Homo sapiens; identical to SEQ ID NO: 1193

SEQ ID NO: 3247 - DNA, 60 bp, Homo sapiens
tttatgcgttttcactacaataacaagtagaacagtagaacagatgattagtcacagcag

SEQ ID NO: 3248 - DNA, 60 bp, Homo sapiens; identical to SEQ ID NO: 1195

SEQ ID NO: 3249 - DNA, 60 bp, Homo sapiens; identical to SEQ ID NO: 1200

SEQ ID NO: 3250 - DNA, 60 bp, Homo sapiens
ccaaaagtgtttgttggcaattattcccctaggctgagcctgctcatgtacctctgatta

SEQ ID NO: 3251 - DNA, 60 bp, Homo sapiens; identical to SEQ ID NO: 1204

SEQ ID NO: 3252 - DNA, 60 bp, Homo sapiens; identical to SEQ ID NO: 713

SEQ ID NO: 3253 - DNA, 60 bp, Homo sapiens; identical to SEQ ID NO: 1206

SEQ ID NO: 3254 - DNA, 60 bp, Homo sapiens; identical to SEQ ID NO: 1207

SEQ ID NO: 3255 - DNA, 60 bp, Homo sapiens; identical to SEQ ID NO: 716

SEQ ID NO: 3256 - DNA, 60 bp, Homo sapiens; identical to SEQ ID NO: 1216

SEQ ID NO: 3257 - DNA, 60 bp, Homo sapiens; identical to SEQ ID NO: 1217

SEQ ID NO: 3258 - DNA, 60 bp, Homo sapiens; identical to SEQ ID NO: 3046

SEQ ID NO: 3259 - DNA, 60 bp, Homo sapiens; identical to SEQ ID NO: 1224

SEQ ID NO: 3260 - DNA, 60 bp, Homo sapiens; identical to SEQ ID NO: 1228

SEQ ID NO: 3261 - DNA, 60 bp, Homo sapiens; identical to SEQ ID NO: 1990

SEQ ID NO: 3262 - DNA, 60 bp, Homo sapiens; identical to SEQ ID NO: 1991

SEQ ID NO: 3263 - DNA, 60 bp, Homo sapiens; identical to SEQ ID NO: 1229

SEQ ID NO: 3264 - DNA, 60 bp, Homo sapiens; identical to SEQ ID NO: 1232

SEQ ID NO: 3265 - DNA, 60 bp, Homo sapiens; identical to SEQ ID NO: 1235

SEQ ID NO: 3266 - DNA, 60 bp, Homo sapiens; identical to SEQ ID NO: 2000

SEQ ID NO: 3267 - DNA, 60 bp, Homo sapiens; identical to SEQ ID NO: 726

SEQ ID NO: 3268 - DNA, 60 bp, Homo sapiens; identical to SEQ ID NO: 730

SEQ ID NO: 3269 - DNA, 60 bp, Homo sapiens; identical to SEQ ID NO: 1248

SEQ ID NO: 3270 - DNA, 60 bp, Homo sapiens; identical to SEQ ID NO: 739

SEQ ID NO: 3271 - DNA, 60 bp, Homo sapiens; identical to SEQ ID NO: 1254

SEQ ID NO: 3272 - DNA, 60 bp, Homo sapiens; identical to SEQ ID NO: 1255

SEQ ID NO: 3273 - DNA, 60 bp, Homo sapiens
gcttcttggtattttctcttgtatctatgtatctagtattgaggcttgctctttcatgtg

SEQ ID NO: 3274 - DNA, 60 bp, Homo sapiens; identical to SEQ ID NO: 744

SEQ ID NO: 3275 - DNA, 60 bp, Homo sapiens; identical to SEQ ID NO: 1266

SEQ ID NO: 3276 - DNA, 60 bp, Homo sapiens; identical to SEQ ID NO: 1269

SEQ ID NO: 3277 - DNA, 60 bp, Homo sapiens; identical to SEQ ID NO: 1276

SEQ ID NO: 3278 - DNA, 60 bp, Homo sapiens; identical to SEQ ID NO: 1278

SEQ ID NO: 3279 - DNA, 60 bp, Homo sapiens
tcttcaaagaatttaggtatttgtttcaccgaaatgaagtgacttattagccattcagcg

SEQ ID NO: 3280 - DNA, 60 bp, Homo sapiens; identical to SEQ ID NO: 752

SEQ ID NO: 3281 - DNA, 60 bp, Homo sapiens; identical to SEQ ID NO: 1281

SEQ ID NO: 3282 - DNA, 60 bp, Homo sapiens; identical to SEQ ID NO: 753

SEQ ID NO: 3283 - DNA, 60 bp, Homo sapiens; identical to SEQ ID NO: 756

SEQ ID NO: 3284 - DNA, 60 bp, Homo sapiens
cataccatgtctgtgtgtggttgtccagaaaatgaggctgaagattcaccaaataagctc

SEQ ID NO: 3285 - DNA, 60 bp, Homo sapiens; identical to SEQ ID NO: 1292

SEQ ID NO: 3286 - DNA, 60 bp, Homo sapiens; identical to SEQ ID NO: 1295

SEQ ID NO: 3287 - DNA, 60 bp, Homo sapiens; identical to SEQ ID NO: 1296

SEQ ID NO: 3288 - DNA, 60 bp, Homo sapiens; identical to SEQ ID NO: 1297

SEQ ID NO: 3289 - DNA, 60 bp, Homo sapiens; identical to SEQ ID NO: 1298

SEQ ID NO: 3290 - DNA, 60 bp, Homo sapiens; identical to SEQ ID NO: 1301

SEQ ID NO: 3291 - DNA, 60 bp, Homo sapiens; identical to SEQ ID NO: 1303

SEQ ID NO: 3292 - DNA, 60 bp, Homo sapiens; identical to SEQ ID NO: 1304

SEQ ID NO: 3293 - DNA, 60 bp, Homo sapiens; identical to SEQ ID NO: 2059

SEQ ID NO: 3294 - DNA, 60 bp, Homo sapiens; identical to SEQ ID NO: 1315

SEQ ID NO: 3295 - DNA, 60 bp, Homo sapiens; identical to SEQ ID NO: 2077

SEQ ID NO: 3296 - DNA, 60 bp, Homo sapiens; identical to SEQ ID NO: 781

SEQ ID NO: 3297 - DNA, 60 bp, Homo sapiens; identical to SEQ ID NO: 1328

SEQ ID NO: 3298 - DNA, 60 bp, Homo sapiens; identical to SEQ ID NO: 1330

SEQ ID NO: 3299 - DNA, 60 bp, Homo sapiens; identical to SEQ ID NO: 1332

SEQ ID NO: 3300 - DNA, 60 bp, Homo sapiens; identical to SEQ ID NO: 1333

SEQ ID NO: 3301 - DNA, 60 bp, Homo sapiens; identical to SEQ ID NO: 1334

SEQ ID NO: 3302 - DNA, 60 bp, Homo sapiens; identical to SEQ ID NO: 1336

SEQ ID NO: 3303 - DNA, 60 bp, Homo sapiens; identical to SEQ ID NO: 1338

SEQ ID NO: 3304 - DNA, 60 bp, Homo sapiens; identical to SEQ ID NO: 1342

SEQ ID NO: 3305 - DNA, 60 bp, Homo sapiens; identical to SEQ ID NO: 1343

SEQ ID NO: 3306 - DNA, 60 bp, Homo sapiens; identical to SEQ ID NO: 1345

SEQ ID NO: 3307 - DNA, 60 bp, Homo sapiens
atgaagcagatttggtctttgtattcttacgttcctctactttgtagctgtggctgtact

SEQ ID NO: 3308 - DNA, 60 bp, Homo sapiens; identical to SEQ ID NO: 2110

SEQ ID NO: 3309 - DNA, 60 bp, Homo sapiens; identical to SEQ ID NO: 1353

SEQ ID NO: 3310 - DNA, 60 bp, Homo sapiens; identical to SEQ ID NO: 1354

SEQ ID NO: 3311 - DNA, 60 bp, Homo sapiens; identical to SEQ ID NO: 792

SEQ ID NO: 3312 - DNA, 60 bp, Homo sapiens; identical to SEQ ID NO: 1359

SEQ ID NO: 3313 - DNA, 60 bp, Homo sapiens; identical to SEQ ID NO: 1364

SEQ ID NO: 3314 - DNA, 60 bp, Homo sapiens; identical to SEQ ID NO: 1365

SEQ ID NO: 3315 - DNA, 60 bp, Homo sapiens; identical to SEQ ID NO: 1990

SEQ ID NO: 3316 - DNA, 60 bp, Homo sapiens; identical to SEQ ID NO: 1366

SEQ ID NO: 3317 - DNA, 60 bp, Homo sapiens; identical to SEQ ID NO: 1371

SEQ ID NO: 3318 - DNA, 60 bp, Homo sapiens; identical to SEQ ID NO: 1372

SEQ ID NO: 3319 - DNA, 60 bp, Homo sapiens; identical to SEQ ID NO: 795

SEQ ID NO: 3320 - DNA, 60 bp, Homo sapiens; identical to SEQ ID NO: 1375

SEQ ID NO: 3321 - DNA, 60 bp, Homo sapiens; identical to SEQ ID NO: 1377

SEQ ID NO: 3322 - DNA, 60 bp, Homo sapiens; identical to SEQ ID NO: 1379

SEQ ID NO: 3323 - DNA, 60 bp, Homo sapiens
tagacatcaagaaaatggatactgttcaaaaatgccccacaaatgttaaccatggcaaaa

SEQ ID NO: 3324 - DNA, 60 bp, Homo sapiens; identical to SEQ ID NO: 1380

SEQ ID NO: 3325 - DNA, 60 bp, Homo sapiens; identical to SEQ ID NO: 1382

SEQ ID NO: 3326 - DNA, 60 bp, Homo sapiens
tcgagcgttaaaatccatgaaaggactcacactggagaaaaaccctgtagctccaacact

SEQ ID NO: 3327 - DNA, 60 bp, Homo sapiens; identical to SEQ ID NO: 1383

SEQ ID NO: 3328 - DNA, 60 bp, Homo sapiens; identical to SEQ ID NO: 2155

SEQ ID NO: 3329 - DNA, 60 bp, Homo sapiens; identical to SEQ ID NO: 1391

SEQ ID NO: 3330 - DNA, 60 bp, Homo sapiens; identical to SEQ ID NO: 1393

SEQ ID NO: 3331 - DNA, 60 bp, Homo sapiens; identical to SEQ ID NO: 1394

SEQ ID NO: 3332 - DNA, 60 bp, Homo sapiens; identical to SEQ ID NO: 1396

SEQ ID NO: 3333 - DNA, 60 bp, Homo sapiens; identical to SEQ ID NO: 1397

SEQ ID NO: 3334 - DNA, 60 bp, Homo sapiens; identical to SEQ ID NO: 1398

SEQ ID NO: 3335 - DNA, 60 bp, Homo sapiens; identical to SEQ ID NO: 2171

SEQ ID NO: 3336 - DNA, 60 bp, Homo sapiens; identical to SEQ ID NO: 1404

SEQ ID NO: 3337 - DNA, 60 bp, Homo sapiens; identical to SEQ ID NO: 1405

SEQ ID NO: 3338 - DNA, 60 bp, Homo sapiens; identical to SEQ ID NO: 1406

SEQ ID NO: 3339 - DNA, 60 bp, Homo sapiens; identical to SEQ ID NO: 1407

SEQ ID NO: 3340 - DNA, 60 bp, Homo sapiens
catggaattgttcctttggccacagtgatctataagaaagatgatattgtagacaccaaa

SEQ ID NO: 3341 - DNA, 60 bp, Homo sapiens; identical to SEQ ID NO: 807

SEQ ID NO: 3342 - DNA, 60 bp, Homo sapiens
aaagccgagttataaagctcttaattacatctcaattggtatcagcaatagacctaaagg

SEQ ID NO: 3343 - DNA, 60 bp, Homo sapiens; identical to SEQ ID NO: 1421

SEQ ID NO: 3344 - DNA, 60 bp, Homo sapiens; identical to SEQ ID NO: 1423

SEQ ID NO: 3345 - DNA, 60 bp, Homo sapiens; identical to SEQ ID NO: 1426

SEQ ID NO: 3346 - DNA, 60 bp, Homo sapiens
gaaaaattaatactatcatgttaatactattattgtcatcccaagaaaaaagatatttta

SEQ ID NO: 3347 - DNA, 60 bp, Homo sapiens; identical to SEQ ID NO: 1430

SEQ ID NO: 3348 - DNA, 60 bp, Homo sapiens; identical to SEQ ID NO: 1434

SEQ ID NO: 3349 - DNA, 60 bp, Homo sapiens; identical to SEQ ID NO: 1435

SEQ ID NO: 3350 - DNA, 60 bp, Homo sapiens
gtttctcttggtcaaaaacacactcaagtcgtctccaagttcgaagcattcagcaaacaa

SEQ ID NO: 3351 - DNA, 60 bp, Homo sapiens; identical to SEQ ID NO: 1439

SEQ ID NO: 3352 - DNA, 60 bp, Homo sapiens; identical to SEQ ID NO: 1440

SEQ ID NO: 3353 - DNA, 60 bp, Homo sapiens; identical to SEQ ID NO: 1441

SEQ ID NO: 3354 - DNA, 60 bp, Homo sapiens; identical to SEQ ID NO: 1442

SEQ ID NO: 3355 - DNA, 60 bp, Homo sapiens; identical to SEQ ID NO: 1444

SEQ ID NO: 3356 - DNA, 60 bp, Homo sapiens; identical to SEQ ID NO: 1445

SEQ ID NO: 3357 - DNA, 60 bp, Homo sapiens; identical to SEQ ID NO: 2213

SEQ ID NO: 3358 - DNA, 60 bp, Homo sapiens; identical to SEQ ID NO: 2214

SEQ ID NO: 3359 - DNA, 60 bp, Homo sapiens; identical to SEQ ID NO: 1448

SEQ ID NO: 3360 - DNA, 60 bp, Homo sapiens; identical to SEQ ID NO: 1450

SEQ ID NO: 3361 - DNA, 60 bp, Homo sapiens; identical to SEQ ID NO: 1454

SEQ ID NO: 3362 - DNA, 60 bp, Homo sapiens; identical to SEQ ID NO: 1455

SEQ ID NO: 3363 - DNA, 60 bp, Homo sapiens; identical to SEQ ID NO: 1456

SEQ ID NO: 3364 - DNA, 60 bp, Homo sapiens; identical to SEQ ID NO: 1459

SEQ ID NO: 3365 - DNA, 60 bp, Homo sapiens; identical to SEQ ID NO: 1463

SEQ ID NO: 3366 - DNA, 60 bp, Homo sapiens; identical to SEQ ID NO: 1464

SEQ ID NO: 3367 - DNA, 60 bp, Homo sapiens; identical to SEQ ID NO: 1466

SEQ ID NO: 3368 - DNA, 60 bp, Homo sapiens; identical to SEQ ID NO: 1467

SEQ ID NO: 3369 - DNA, 60 bp, Homo sapiens; identical to SEQ ID NO: 1469

SEQ ID NO: 3370 - DNA, 60 bp, Homo sapiens; identical to SEQ ID NO: 1472

SEQ ID NO: 3371 - DNA, 60 bp, Homo sapiens; identical to SEQ ID NO: 1475

SEQ ID NO: 3372 - DNA, 60 bp, Homo sapiens; identical to SEQ ID NO: 1477

SEQ ID NO: 3373 - DNA, 60 bp, Homo sapiens; identical to SEQ ID NO: 1484

SEQ ID NO: 3374 - DNA, 60 bp, Homo sapiens; identical to SEQ ID NO: 833

SEQ ID NO: 3375 - DNA, 60 bp, Homo sapiens; identical to SEQ ID NO: 1487

SEQ ID NO: 3376 - DNA, 60 bp, Homo sapiens
gttttatgtgaaatagagttttcagatttatgtagcatggaaagttttaatacgtcagag

SEQ ID NO: 3377 - DNA, 60 bp, Homo sapiens
aaagacgtcaatatctgctcacatcttactaaacaccagagagttcatgcttaataaaag

SEQ ID NO: 3378 - DNA, 60 bp, Homo sapiens; identical to SEQ ID NO: 1491

SEQ ID NO: 3379 - DNA, 60 bp, Homo sapiens; identical to SEQ ID NO: 1493

SEQ ID NO: 3380 - DNA, 60 bp, Homo sapiens; identical to SEQ ID NO: 1495

SEQ ID NO: 3381 - DNA, 60 bp, Homo sapiens; identical to SEQ ID NO: 1497

SEQ ID NO: 3382 - DNA, 60 bp, Homo sapiens; identical to SEQ ID NO: 1500

SEQ ID NO: 3383 - DNA, 60 bp, Homo sapiens; identical to SEQ ID NO: 1501

SEQ ID NO: 3384 - DNA, 60 bp, Homo sapiens
ggacaggttccattctattccgacttgtgttgctacatatgtccatgtaacaatacagaa

SEQ ID NO: 3385 - DNA, 60 bp, Homo sapiens; identical to SEQ ID NO: 1502

SEQ ID NO: 3386 - DNA, 60 bp, Homo sapiens; identical to SEQ ID NO: 1504

SEQ ID NO: 3387 - DNA, 60 bp, Homo sapiens; identical to SEQ ID NO: 1506

SEQ ID NO: 3388 - DNA, 60 bp, Homo sapiens; identical to SEQ ID NO: 1508

SEQ ID NO: 3389 - DNA, 60 bp, Homo sapiens; identical to SEQ ID NO: 1513

SEQ ID NO: 3390 - DNA, 60 bp, Homo sapiens; identical to SEQ ID NO: 1514

SEQ ID NO: 3391 - DNA, 60 bp, Homo sapiens; identical to SEQ ID NO: 1516

SEQ ID NO: 3392 - DNA, 60 bp, Homo sapiens; identical to SEQ ID NO: 1519

SEQ ID NO: 3393 - DNA, 60 bp, Homo sapiens; identical to SEQ ID NO: 2287

SEQ ID NO: 3394 - DNA, 60 bp, Homo sapiens; identical to SEQ ID NO: 1521

SEQ ID NO: 3395 - DNA, 60 bp, Homo sapiens
tccaggtgcctttaatgtactgtaacctcacaactccaagtccacagaatatttcaaact

SEQ ID NO: 3396 - DNA, 60 bp, Homo sapiens; identical to SEQ ID NO: 1525

SEQ ID NO: 3397 - DNA, 60 bp, Homo sapiens; identical to SEQ ID NO: 1528

SEQ ID NO: 3398 - DNA, 60 bp, Homo sapiens
agttgcttatggcatacaaggctaaaattaattcagctatttaatcttaataattattat

SEQ ID NO: 3399 - DNA, 60 bp, Homo sapiens; identical to SEQ ID NO: 1531

SEQ ID NO: 3400 - DNA, 60 bp, Homo sapiens; identical to SEQ ID NO: 1532

SEQ ID NO: 3401 - DNA, 60 bp, Homo sapiens; identical to SEQ ID NO: 1534

SEQ ID NO: 3402 - DNA, 60 bp, Homo sapiens; identical to SEQ ID NO: 1535

SEQ ID NO: 3403 - DNA, 60 bp, Homo sapiens; identical to SEQ ID NO: 1544

SEQ ID NO: 3404 - DNA, 60 bp, Homo sapiens; identical to SEQ ID NO: 855

SEQ ID NO: 3405 - DNA, 60 bp, Homo sapiens; identical to SEQ ID NO: 1549

SEQ ID NO: 3406 - DNA, 60 bp, Homo sapiens; identical to SEQ ID NO: 1550

SEQ ID NO: 3407 - DNA, 60 bp, Homo sapiens; identical to SEQ ID NO: 856

SEQ ID NO: 3408 - DNA, 60 bp, Homo sapiens; identical to SEQ ID NO: 1560

SEQ ID NO: 3409 - DNA, 60 bp, Homo sapiens; identical to SEQ ID NO: 1562

SEQ ID NO: 3410 - DNA, 60 bp, Homo sapiens; identical to SEQ ID NO: 1563

SEQ ID NO: 3411 - DNA, 60 bp, Homo sapiens; identical to SEQ ID NO: 1566

SEQ ID NO: 3412 - DNA, 60 bp, Homo sapiens
aatggcagttgccaccattctgctaaaaatggcagttgtgtgagttttatttcttagaaa

SEQ ID NO: 3413 - DNA, 60 bp, Homo sapiens; identical to SEQ ID NO: 1569

SEQ ID NO: 3414 - DNA, 60 bp, Homo sapiens; identical to SEQ ID NO: 1570

SEQ ID NO: 3415 - DNA, 60 bp, Homo sapiens; identical to SEQ ID NO: 864

SEQ ID NO: 3416 - DNA, 60 bp, Homo sapiens; identical to SEQ ID NO: 1578

SEQ ID NO: 3417 - DNA, 60 bp, Homo sapiens; identical to SEQ ID NO: 1579

The invention claimed is:

1. A reagent that comprises a set of all probes consisting of the nucleotide sequences of SEQ ID NOs: 220, 506, 508, 523, 538, 554, 570, 589, 597, 602, 618, 654, 689, 701, 726, 744, 762, 763, 781, 795, and 849; or
    that comprises a set of all probes consisting of the nucleotide sequences of SEQ ID NOs: 3030 to 3054,
    the reagent further comprising a DNA microarray wherein the probes are bound to a substrate.

2. A method for detecting any one of gastric cancer, colorectal cancer, pancreatic cancer and biliary tract cancer in a subject, comprising
    (i) obtaining a set of the gene expression profiles of all genes corresponding to probes consisting of the nucleotide sequences of SEQ ID NOs: 220, 506, 508, 523, 538, 554, 570, 589, 597, 602, 618, 654, 689, 701, 726, 744, 762, 763, 781, 795, and 849, in peripheral blood from the subject, or a set of all genes corresponding to probes consisting of the nucleotide sequences of SEQ ID NOs: 3030 to 3054, in peripheral blood from the subject, by measuring the expression of the genes using the reagent of claim 1;
    (ii) analyzing the expression profiles, and if the expression profiles obtained from the subject are analogous to expression profiles obtained from a gastric cancer, colorectal cancer, pancreatic cancer, and biliary tract cancer patient, the subject can be determined as having gastric cancer, colorectal cancer, pancreatic cancer, or biliary tract cancer, or comparing the expression profiles obtained from the subject with expression profiles obtained from a normal subject and making a determination based on a difference in expression profiles between the subject and the normal subject;
    (iii) detecting any one of gastric cancer, colorectal cancer, pancreatic cancer and biliary tract cancer based on the expression profiles; and
    (iv) identifying which subject has any one of gastric cancer, colorectal cancer, pancreatic cancer and biliary tract cancer.

3. The method of claim 2 for detecting gastric cancer in a subject.

4. The method of claim 2 for detecting colorectal cancer in a subject.

5. The method of claim 2 for detecting pancreatic cancer in a subject.

6. The method of claim 2 for detecting biliary tract cancer in a subject.

* * * * *